US008586726B2

(12) United States Patent
Califano et al.

(10) Patent No.: US 8,586,726 B2
(45) Date of Patent: Nov. 19, 2013

(54) TISSUE-SPECIFIC MICRORNAS AND COMPOSITIONS AND USES THEREOF

(75) Inventors: Andrea Califano, New York, NY (US); Riccardo Dalla-Favera, New York, NY (US)

(73) Assignee: The Trustees of Columbia University in the City of New York, New York, NY (US)

( * ) Notice: Subject to any disclaimer, the term of this patent is extended or adjusted under 35 U.S.C. 154(b) by 197 days.

(21) Appl. No.: 12/688,680

(22) Filed: Jan. 15, 2010

(65) Prior Publication Data

US 2010/0197772 A1     Aug. 5, 2010

Related U.S. Application Data

(63) Continuation-in-part of application No. PCT/US2008/070082, filed on Jul. 15, 2008.

(60) Provisional application No. 60/950,474, filed on Jul. 18, 2007, provisional application No. 61/020,625, filed on Jan. 11, 2008.

(51) Int. Cl.
    *C07H 21/04*     (2006.01)
    *C07H 21/02*     (2006.01)
    *A61K 48/00*     (2006.01)

(52) U.S. Cl.
    USPC ..... 536/24.5; 536/23.1; 536/24.3; 536/24.31; 536/24.33; 514/44

(58) Field of Classification Search
None
See application file for complete search history.

(56) References Cited

U.S. PATENT DOCUMENTS

| | | | |
|---|---|---|---|
| 3,536,809 A | 10/1970 | Applezweig | |
| 3,598,123 A | 8/1971 | Zaffaroni | |
| 3,845,770 A | 11/1974 | Theeuwes et al. | |
| 3,916,899 A | 11/1975 | Theeuwes et al. | |
| 4,008,719 A | 2/1977 | Theeuwes et al. | |
| 4,683,195 A | 7/1987 | Mullis et al. | |
| 4,710,384 A | 12/1987 | Rotman | |
| 5,059,595 A | 10/1991 | Le Grazie | |
| 5,073,543 A | 12/1991 | Marshall et al. | |
| 5,120,548 A | 6/1992 | McClelland et al. | |
| 5,139,941 A | 8/1992 | Muzyczka et al. | |
| 5,252,479 A | 10/1993 | Srivastava | |
| 5,270,163 A | 12/1993 | Gold et al. | |
| 5,354,556 A | 10/1994 | Sparks et al. | |
| 5,427,916 A | 6/1995 | Gewirtz et al. | |
| 5,582,981 A | 12/1996 | Toole et al. | |
| 5,591,767 A | 1/1997 | Mohr et al. | |
| 5,639,476 A | 6/1997 | Oshlack et al. | |
| 5,674,533 A | 10/1997 | Santus et al. | |
| 5,733,566 A | 3/1998 | Lewis | |
| 5,756,291 A | 5/1998 | Griffin et al. | |
| 5,849,902 A | 12/1998 | Arrow et al. | |
| 5,989,912 A | 11/1999 | Arrow et al. | |
| 6,083,685 A * | 7/2000 | Petrik | 435/5 |
| 7,232,806 B2 | 6/2007 | Tuschl et al. | |
| 2002/0086356 A1 | 7/2002 | Tuschl et al. | |
| 2002/0173478 A1 | 11/2002 | Gewirtz | |
| 2004/0014113 A1 | 1/2004 | Yang et al. | |
| 2004/0018176 A1 | 1/2004 | Tolentino et al. | |
| 2005/0182005 A1 | 8/2005 | Tuschl et al. | |
| 2005/0261218 A1 | 11/2005 | Esau et al. | |
| 2006/0051771 A1 | 3/2006 | Murphy et al. | |
| 2006/0105360 A1 | 5/2006 | Croce et al. | |
| 2006/0142228 A1 | 6/2006 | Ford et al. | |
| 2007/0072204 A1 | 3/2007 | Hannon et al. | |
| 2007/0123482 A1 | 5/2007 | Stoffel et al. | |

FOREIGN PATENT DOCUMENTS

| | | |
|---|---|---|
| WO | WO-88/04300 | 6/1988 |
| WO | WO-93/24641 | 12/1993 |
| WO | WO-94/13788 | 6/1994 |
| WO | WO-97/42317 | 11/1997 |
| WO | WO-99/07409 | 2/1999 |
| WO | WO-99/27133 | 6/1999 |
| WO | WO-99/32619 | 7/1999 |
| WO | WO-99/54506 | 10/1999 |
| WO | WO-00/01846 | 1/2000 |
| WO | WO-00/20040 | 4/2000 |
| WO | WO-00/44895 | 8/2000 |
| WO | WO-00/44914 | 8/2000 |
| WO | WO-01/29058 | 4/2001 |
| WO | WO-01/36646 | 5/2001 |
| WO | WO-03/29459 | 4/2003 |
| WO | WO-2005/097205 | 10/2005 |
| WO | WO-2009/012263 | 1/2009 |

OTHER PUBLICATIONS

Hinkley, A. C. D. a. D. V. *Bootstrap Methods and their Applications* (Cambridge University Press, New York, 1997).
Klein et al., New Insights into the phenotype and cell derivation of B cell chronic lymphocytic leukemia, Curr Top Microbiol Immunol, vol. 294, pp. 31-49 (2005).
International Search Report and Written Opinion mailed Jan. 22, 2009 for International Patent Application No. PCT/US08/70082 filed Jul. 15, 2008.
"Transcription and Translation" B. D. Hames & S. J. Higgins eds. 1984.
Alexander et al., "Selected technologies to control genes and their products for experimental and clinical purposes," (2007) Arch Immunol Ther Exp (Warsz). May-Jun. 2007;55(3):139-49.
Anderson (1998), "Human gene therapy," Nature 392:25-30.
B. Perbal, A Practical Guide to Molecular Cloning (1984).

(Continued)

*Primary Examiner* — Amy Bowman
(74) *Attorney, Agent, or Firm* — Wilmer Cutler Pickering Hale and Dorr LLP

(57) ABSTRACT

The invention provides for isolated nucleic acid sequences of newly discovered micro RNAs that have been identified to exist in normal Human B cells and/or in tumor-related Human B cells, using an integrated bioinformatics method and pipeline described herein.

14 Claims, 38 Drawing Sheets

(56) References Cited

OTHER PUBLICATIONS

Bandres et al., "MicroRNAs as Cancer Players: Potential Clinical and Biological Effects," (2007) DNA Cell Biol. 26(5):273-82.
Bartel, D. P. (2004). MicroRNAs: genomics, biogenesis, mechanism, and function. Cell 116, 281-297.
Barutcuoglu et al., "Hierarchical multi-label prediction of gene function," Bioinformatics, vol. 22, pp. 830-836 (2006).
Bass (2001), "The short answer," Nature, 411, 428 429.
Basso et al., "Identification of the Human mature B cell miRNome," Immunity, vol. 30, pp. 744-752, (May 2009).
Basso, K., Margolin, A. A., Stolovitzky, G., Klein, U., Dalla-Favera, R., and Califano, A. (2005). Reverse engineering of regulatory networks in human B cells. Nat Genet 37, 382-390.
Been and Cech, "One binding site determines sequence specificity of tetrahymena pre-rRNA Self-splicing, Trans-Splicing, and RNA Enzyme Activity," 1986, Cell, 47:207-216.
Bentwich, I. et al. Identification of hundreds of conserved and nonconserved human microRNAs. *Nat Genet* 37, 766-70 (2005).
Blind (1999), "Cytoplasmic RNA modulators of an inside-out signal-transduction cascade," *Proc. Nat'l. Acad. Sci. USA* 96:3606-3610.
Brummelkamp et al. (2002), "A System for Stable Expression of Short Interfering RNAs in mammalian Cells," *Science* 296:550-553.
Calabrese, J. M., Seila, A. C., Yeo, G. W. & Sharp, P. A. RNA sequence analysis defines Dicer's role in mouse embryonic stem cells. *Proc Natl Acad Sci U S A* 104, 18097-102 (2007).
Caldas et al., "sizing up miRNAS as cancer genes," Nature medicine, vol. 11, pp. 712-714 (Jul. 2005).
Calin et al., "Genomics of Chronic Lymphocytic Leukemia MicroRNAs as New Players with Clinical Significance," Semin Oncol 33: 167-173 (2006).
Calin et al., "Human microRNA genes are frequently located at fragile sites and genomic regions involved in cancers," PNAS, vol. 101, pp. 2999-3004 (Mar. 2004).
Calin et al., "MicroRNA profiling reveals distinct signatures in B cell chronic lymphocytic leukemias," PNAS, vol. 101, pp. 11755-11760 (Aug. 2004).
Calin et al., "MicroRNA signatures in human cancers," Nature reviews, vol. 6, pp. 857-866 (Nov. 2006).
Calin et al., "MicroRNA-Cancer Connection: the Beginning of a New tale," Cancer Res, vol. 66, pp. 7390-7394 (2006).
Calin, G. A. et al. A MicroRNA signature associated with prognosis and progression in chronic lymphocytic leukemia. *N. Engl J Med* 353, 1793-801 (2005).
Calin, G. A. et al. Frequent deletions and down-regulation of micro-RNA genes miR15 and miR16 at 13q14 in chronic lymphocytic leukemia. *Proc Natl Acad Sci U S A* 99, 15524-9 (2002).
Chen, C. Z., Li, L., Lodish, H. F. & Bartel, D. P. MicroRNAs modulate hematopoietic lineage differentiation. *Science* 303, 83-6 (2004).
Colas et al., (1996), "Genetic selection of peptide aptamers that recognize and inhibit cyclin-dependent kinase 2," Nature 380:548-550.
Costinean et al., "Pre-B cell proliferation and lymphoblastic leukemia/high grade lymphoma in Eµ-miR155 transgenic mice," PNAS, vol. 10, pp. 7024-7029 (May 2006).
Crooke, 1997, "Advances in understanding the pharmacological property of antisense oligonucleotides," Ad. Pharmacol., 40, 1-49.
Crooke, 1998, "Antisense Therapeutics," Biotech. Genet. Eng. Rev., 15, 121-157.
Crooke, 2000, "Progress in antisense technology. The end of the beginning," Methods Enzymol., 313, 3-45.
Culture of Animal Cells (R. I. Freshney, Alan R. Liss, Inc., 1986).
Cummins, J. M., He, Y., Leary, R. J., Pagliarini, R., Diaz, L. A., Jr., Sjoblom, T., Barad, O., Bentwich, Z., Szafranska, A. E., Labourier, E., et al. (2006). The colorectal microRNAome. Proc Natl Acad Sci U S A 103, 3687-3692.
Dallas et al., "RNAi: A novel antisense technology and its therapeutic potential," (2006) Med. Sci. Monit.12(4):RA67-74.

Delihas et al., 1997, "Natural antisense RNA/target RNA interactions: Possible models for antisense oligonucleotide drug design," Nature, 15, 751-753.
DeRisi et al., "Use of a cDNA microarray to analyse gene expression patterns in human cancer," Nature genetics vol. 14, pp. 457-460 (Dec. 1996).
DNA Cloning, vols. I and II (D. N. Glover ed., 1985).
Dornburg (1995), "Reticuloendotheliosis virus and derived vectors," *Gene Therap.* 2:301-310.
Dorsett, Y., et al. (2008). MicroRNA-155 suppresses activation-induced cytidine deaminase-mediated Myc-Igh translocation. Immunity 28, 630-638.
Dvorak et al., 2003, *Biomed Pap Med Fac Univ Palacky Olomouc Czech Repub*147(2):131-5.
Eglitis (1988), "Retroviral vectors for introduction of genes into mammalian cells," Biotechniques 6:608-614.
Eis et al., "Accumulation of miR-155 and BIC RNA in human B cell lymphomas," PNAS, vol. 102, pp. 3627-3632 (Mar. 2005).
Eisen, M. B., Spellman, P. T., Brown, P. O. & Botstein, D. Cluster analysis and display of genome-wide expression patterns. *Proc Natl Aced Sci U S A* 95, 14863-8 (1998).
Elbashir et al., (2001), "Duplexes of 21-nucleotide RNAs mediate RNA interference in cultured mammalian cells," Nature, 411, 494 498.
Ellington and Szostak (1990),"In vitro selection of RNA molecules that bind specific ligands," Nature 346:818.
Fienberg et al. (1983), "A Technique for radiolabeling DNA Restricyion Endonuclease fragments to high specific activity," Anal. Biochem. 132:6-13.
Filipowicz, W., Bhattacharyya, S. N., and Sonenberg, N. (2008). Mechanisms of post-transcriptional regulation by microRNAs: are the answers in sight? Nat Rev Genet 9, 102-114.
Fisher et al. (1996), "Transduction with recombinant adeno-associated virus for gene therapy is limited by leading-strand synthesis," J. Virol., 70:520-532.
Fodor et al., 1991; "Light-Directed, spatially addressable parallel chemical synthesis," Maskos and Southern, 1992.
Gaidatzis et al., "Inference of miRNA targets using evolutionary conservation and pathway analysis," BMC Bioinformatics, vol. 8:69 p. 1-22 (2007).
Gene Transfer Vectors for Mammalian Cells (J. H. Miller and M. P. Calos eds., 1987, Cold Spring Harbor Laboratory).
Griffiths-Jones, S. miRBase: the microRNA sequence database. *Methods Mol Biol* 342, 129-38 (2006).
Griffiths-Jones, S., Grocock, R. J., van Dongen, S., Bateman, A. & Enright, A. J. miRBase: microRNA sequences, targets and gene nomenclature. *Nucleic Acids Res* 34, D140-4 (2006).
Grimson, A. et al. MicroRNA targeting specificity in mammals: determinants beyond seed pairing. *Mol. Cell* 27, 91-105 (2007).
Hammond SM, 2006; "MicroRNAs as oncogenes," Curr Opin Genet Dev. 16(1):4-9.
Handbook of Experimental Immunology, vols. I-IV (D. M. Weir and C. C. Blackwell, eds., 1986).
Harrell, F. E. *Regression modeling strategies: with applications to linear models, logistic regression, and survival analysis* (Springer, New York, 2001).
Haseloff et al., "Simple RNA enzymes with new and highly specific endoribonuclease activities," nature, vol. 334, pp. 585-591 (Aug. 1988).
He, L. et al. A microRNA polycistron as a potential human oncogene. *Nature* 435, 828-33 (2005).
Huizenga and Szostak (1995), "A DNA aptamer that binds adenosine and ATP," Biochem. 34:656-665.
Hwang and Mendell, 2006,"MicroRNAs in cell proliferation cell death, and tumorigenesis," Br J Cancer 94(6):776-80.
James W., (2001), "Nucleic acid and polypeptide aptamers: a powerful approach to ligand discovery," Current Opinion in Pharmacology, 1:540-546.
Jay et al., "miRNA Profiling for diagnosis and prognosis of human cancer," DNA and Cell Biology, vol. 26, pp. 293-300 (2007).
John, B., Enright, A. J., Aravin, A., Tuschl, T., Sander, C., and Marks, D. S. (2004). Human MicroRNA targets. PLoS Biol 2, e363.

(56) References Cited

OTHER PUBLICATIONS

Kalota et al., (2006) "Progress in the development of Nucleic Acid Therapeutics," Handb. Exp. Pharmacol. 173:173-96.
Kawahara, Y. et al. Redirection of silencing targets by adenosine-to-inosine editing of miRNAs. *Science* 315, 1137-40 (2007).
Kim, V. N. (2005). MicroRNA biogenesis: coordinated cropping and dicing. Nat Rev Mol Cell Biol 6, 376-385.
Klein, U. & Dalla-Favera, R. Germinal centres: role in B-cell physiology and malignancy. *Nat Rev Immunol* 8, 22-33 (2008).
Klein, U. et al. Transcriptional analysis of the B cell germinal center reaction. *Proc Natl Acad Sci U S A* 100, 2639-44 (2003).
Kricka, "Nonisotopic DNA Probe Techniques", Academic Press San Diego, Calif. (1992).
Krützfeldt et al., 2007, "Specificity, duplex degradation and subcellular localization of antagomirs," Nuc Acid Res 35(9): 2885-2892.
Kuppers, R., and Dalla-Favera, R. (2001). Mechanisms of chromosomal translocations in B cell lymphomas. Oncogene 20, 5580-5594.
Landgraf, P. et al. A mammalian microRNA expression atlas based on small RNA library sequencing. *Cell* 129, 1401-14 (2007).
Lau, N. C., Lim, L. P., Weinstein, E. G. & Bartel, D. P. An abundant class of tiny RNAs with probable regulatory roles in *Caenorhabditis elegans*. *Science* 294, 858-62 (2001).
Lawrie et al., "MicroRNA expression distinguishes between germinal center B cell-like and activated B cell-like subtypes of diffuse large B cell lymphoma," Int. J Cancer, vol. 121, pp. 1156-1161 (2007).
Lee et al. (2002), "Expression of small interfering RNAs targeted against HIV-1 rev transcripts in human cells,"*Nat. Biotechnol.* 20:500-505.
Lee et al., "Systematic evaluation of microRNA processing patterns in tissues, cell lines, and tumors," RNA, vol. 14, pp. 35-42 (2008).
Lee, E. J. et al. Systematic evaluation of microRNA processing patterns in tissues, cell lines, and tumors. *Rna* 14, 35-42 (2007).
Leung and Whittaker (2005), "RNA Interference: from gene silencing to gene-specific therapeutics," Pharmacol Ther. 107(2):222-39.
Li, Q. J. et al. miR-181a is an intrinsic modulator of T cell sensitivity and selection. *Cell* 129, 147-61 (2007).
Lindow et al., "Principles and limitations of computational MicroRNA Gene and target finding," DNA and Cell Biology, vol. 26, pp. 339-351 (2007).
Lockhart et al., "Expression monitoring by hybridization to high-density oligonucleotida arrays," Nature Biotechnology, vol. 14, pp. 1675-1680 (Dec. 1996).
Lorsch and Szostak (1994),"In vitro selection of RNA Aptamers specific for Cyanobalamin," Biochem. 33:973.
Lu et al., (2005), "In vivo application of RNA interference: from functional Genomics to therapeutics," Adv Genet. 54:117-42.
Lu, J. et al. MicroRNA expression profiles classify human cancers. *Nature* 435, 834-8 (2005).
Luciano, D. J., Mirsky, H., Vendetti, N. J. & Maas, S. RNA editing of a miRNA precursor. *Rna* 10, 1174-7 (2004).
Lutzelburger et al., (2006) "Strategies to identified Potential Therapeutic target sites in RNA," Handb. Exp. Pharmacol. 173:243-59.
Mannironi et al., "In vitro selection of dopamine RNA ligands," (1997) Biochem. 36:9726.
Maskos et al., "Oligonucleotide hybridisations on glass supports: a novel linker for oligonucleotide synthesis and hybridisation properties of oligonucleotides synthesised in situ," Nucleic Acids Research, vol. 20, pp. 1679-1684 (1992).
Maskos et al., "Parallel analysis off oligodeoxyribonucleotide (oligonucleotide) interactions.I. Analysis of factors influencing oligonucleotide duplex formation," Nucleic Acids Research, vol. 20, pp. 1675-1678 (1992).
Mattes et al., (2007) "Regulation of MicroRNA by Antagomirs. A NEw Class of Pharmacological Antagonists for the Specific Regulation of Gene Function?," Am J Resp Cell Mol Biot 36: 8-12.
McCaffrey et al., 2002, "RNA interference in adult mice," Nature, 418:38-9.
McManus et al., 2002, "Gene silencing using micro-RNA designed hairpins," RNA, 8:842-50.

Mendell, JT, 2005, "MicroRNAs. Critical regulators of develpment, cellular physiology and malignancy," Cell Cycle 4(9):1179-84.
Methods in Enzymology, vols. 154 and 155 (Wu et al. eds.).
Michael, M. Z., SM, O. C., van Hoist Pellekaan, N. G., Young, G. P. & James, R. J. Reduced accumulation of specific microRNAs in colorectal neoplasia. *Mol. Cancer Res* 1, 882-91 (2003).
Miller (1990), "Retrovirus Packaging Cells," Hum. Gene Therap. 1:5-14.
Miranda, K. C. et al. A pattern-based method for the identification of MicroRNA binding sites and their corresponding heteroduplexes. *Cell* 126, 1203-17 (2006).
Miyagishi et al. (2002), "U6 promoter-driven siRNAs with four uridine 3' overhangs efficiently suppress targeted gene expression in mammalian cells," Nat. Biotechnol. 20:497-500.
Molecular Cloning a Laboratory Manual, 2nd Ed., ed. by Sambrook, Fritsch and Maniatis (Cold Spring Harbor Laboratory Press: 1989).
Mourelatos, Z., Dostie, J., Paushkin, S., Sharma, A., Charroux, B., Abel, L., Rappsilber, J., Mann, M., and Dreyfuss, G. (2002). miRNPs: a novel class of ribonucleoproteins containing numerous microRNAs. Genes Dev 16, 720-728.
Neilson, J. R., Zheng, G. X., Burge, C. B. & Sharp, P. A. Dynamic regulation of miRNA expression in ordered stages of cellular development. *Genes Dev* 21, 578-89 (2007).
Nucleic Acid Hybridization; B. D. Hames & S. J. Higgins eds. 1984.
O'Driscoll, "The emerging world of MicroRNAs," Anticancer Research, vol. 26, pp. 4271-4278 (2006).
Oligonucleotide Synthesis (M. J. Gait ed., 1984).
Osada and Takahashi, 2007, "MicroRNAs in biological processe and carcinogenesis," Carcinogenesis 28(1):2-12.
Paddison et al. (2002), "Short hairpin RNAs (shRNAs) induce sequence-specific silencing in mammalian cells," Genes Dev. 16:948-958.
Paul et al. (2002), "Effective expression of small interfering RNA in human cells," Nat. Biotechnol. 20:505-508.
Pekarsky et al., "Tcl1 Expression in Chronic Lymphocytis leukemia is regulated by miR-29 and miR-18," Cancer Res., vol. 66, pp. 11590-11593 (2006).
Piccaluga et al., "Gene Expression analysis of peripheral T cell Lymphoma, unspecified reveals distinct profiles and new potential therapeutic targets," The Journal of Clinical Investigation, vol. 117, pp. 823-834 (2007).
Pietu et al., "Novel Gene transcripts preferentially expressed in Human Muscles revealed by quatitative hybridization of a High density cDNA Array," Genome Research vol. 6, pp. 492-503 (1996).
Rabinowitz J. E. et al. (2002), "Cross-Packaging of a single adeno-associated virus (AAV) type 2 vector genome into AAV Serotypes enables transduction with broad specificity," J Virol 76:791-801.
Ramkissoon et al., "Hematopoietic-specific microRNA expression in human cells," Leukemia Research, vol. 30, pp. 643-647 (2006).
Rigby et al. (1977), "Labeling deoxyribonucleic acid to high specific activity in vitro by nick translation with DNA polymerase I," J. Mol. Biol. 113:237-251.
Rodriguez, A. et al. Requirement of bic/microRNA-155 for normal immune function. *Science* 316, 608-11 (2007).
Romkes et al., 2005, "Strategies for measurement of biotransformation enzyme gene expression," Methods Mol Biol. ;291:387-98.
Rudel, S., Flatley, A., Weinmann, L., Kremmer, E., and Meister, G. (2008). A multifunctional human Argonaute2-specific monoclonal antibody. Rna 14, 1244-1253.
Samulski et al. (1987), "A Recombinant plasmid from which an infectious adeno-associated virus genome can be excised in vitro and its use to study viral replication," J. Virol. 61:3096-3101.
Samulski et al. (1989), "Helper-Free stocks of recombinant adeno-associated viruses: normal integration does not require viral gene expression," J. Virol. 63:3822-3826.
Sasaki et al., 2003, "Identification of eight members of argonaute family in the human genome," Genomics 82, 323-330.
Schena et al., "Parallel human genome analysis: Microarray-based expression monitoring of 1000 genese," Proc. Natl. Acad. sci. USA, vol. 93, pp. 10614-10619 (Oct. 1996).
Schena et al., "Quantitative monitoring of Gene Expression Patterns with a complementary DNA Microarray," Science vol. 270, pp. 467-470 (1995).

(56) References Cited

OTHER PUBLICATIONS

Schmajuk et al., 1999, "Antisense oligonucleotides with different backbones," J. Biol. Chem., 274, 21783-21789.
Schwartz, S. et al. Human-mouse alignments with BLASTZ. *Genome Res* 13, 103-7 (2003).
Shalon et al., "A DNA microarray system for analyzing complex DNA samples using two-color fluorescent probe hybridization," Genome Research, vol. 6, pp. 639-645 (1996).
Sharbati-Tehrani, S., Kutz-Lohroff, B., Bergbauer, R., Scholven, J., and Einspanier, R. (2008). miR-Q: a novel quantitative RT-PCR approach for the expression profiling of small RNA molecules such as miRNAs in a complex sample. BMC Mol Biol 9, 34.
Shivdasani RA, 2006, "MicroRNAs: regulators of gene expression and cell differentiation," Blood 108(12):3646-53.
Stein and Cheng (1993), "Antisense Oligonucleotides as therapeutic agents—Is the bullet really magical?," Science 261:1004.
Stein et al., 1997, "A specificity comparison of four antisense types: morpholino, 2'-O-Methyl RNA, DNA and Phosphorothioate,DNA," Antisense N. A. Drug Dev. , 7, 151.
Takeshita and Ochiva (2006), "Therapeutic potential of RNA interference against cancer," Cancer Sci. 97(8):689-96.
Teng, G., et al. (2008). MicroRNA-155 is a negative regulator of activation-induced cytidine deaminase. Immunity 28, 621-629.
Thai, T. H., et al. (2007). Regulation of the germinal center response by microRNA-155. *Science* 316, 604-608.
Thomson, J. M. et al. Extensive post-transcriptional regulation of microRNAs and its implications for cancer. *Genes Dev* 20, 2202-7 (2006).
Troyanskaya et al., A Bayesian framework for combining heterogeneous data sources for gene function prediction (in *Saccharomyces cerevisiae*), PNAS, vol. 100, pp. 8348-8353 (Jul. 2003).
Tuerk and Gold (1990), "Systematic evolution of ligands by exponential enrichment: RNA ligands to bacteriophage T4 DNA polymerase," Science 249:505.
Tuschl (2002), "Expanding small RNA interference," Nat. Biotechnol, 20:446-448.
Venturini et al., "Expression of the miR-17-92 polycistron in chronic myeloid leukemia (CML) CD34+ cells," Blood, vol. 109, pp. 4399-4405 (2007).
Woodward, "Immobilized Cells and Enzymes" (IRL Press, 1986).
Xia et al. (2002), "siRNA-mediated gene silencing in vitro and in vivo," Nat. Biotech. 20:1006-1010.
Xiao, C. et al. MiR-150 Controls B Cell Differentiation by Targeting the Transcription Factor c-Myb. *Cell* 131, 146-59 (2007).
Xu and Li (2007), "MicroRNA gene expression in matignant lymphoproliferative disorders," Chin Med J (Engl). 120(11):996-9.
Yu et al., "RNA interference by expression of short-interfering RNAs and Hairpin RNAs in mammalian cells," Proc Natl Acad Sci USA, 99:6047-52.
Yu et al., 2002, "Unique MicroRNA signature and clinical outcome of cancers," DNA and Cell Biology, vol. 26, pp. 283-292.
Zaug and Cech, 1986, "The intervening Sequence RNA of tetrahymena is an enzyme," Science, 231:470-475.
Zaug, et al., 1984, "A labile phosphodiester bond at the ligation junction in a circular intervening sequence RNA," Science, 224:574-578.
Zeng et al. (2002), "Both natural and designed micro RNAs can inhibit the expression of cognate mRNAs when expressed in human cells," Molecular Cell 9:1327-1333.
Zhang et al., 2007 "MicroRNAs as oncogenes and tumor suppressors," Dev Biol. 302(1):1-12.
Zhao et al., "High-density cDNA filter analysis: a novel approach for large-scale, quantitative analysis of gene expression," Gene, vol. 156, pp. 207-213 (1995).
Zhou et al., "miR-150, a microRNA expressed in mature B and T cells, blocks early B cell development when expressed prematurly," PNAS vol. 104, pp. 7080-7085 (Apr. 2007).

* cited by examiner

New
Total: 57

Known
Total: 102

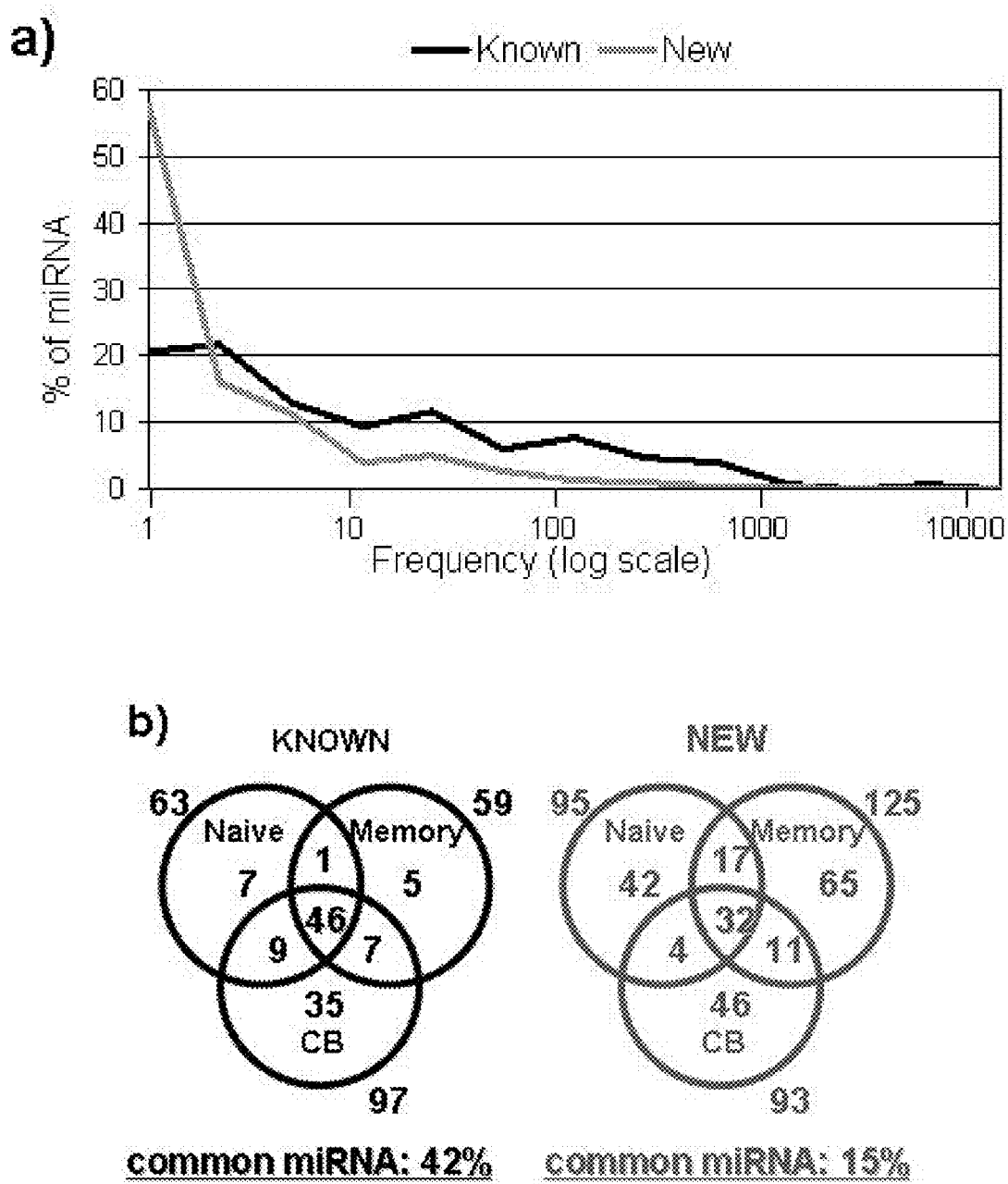
FIGS. 13A-B

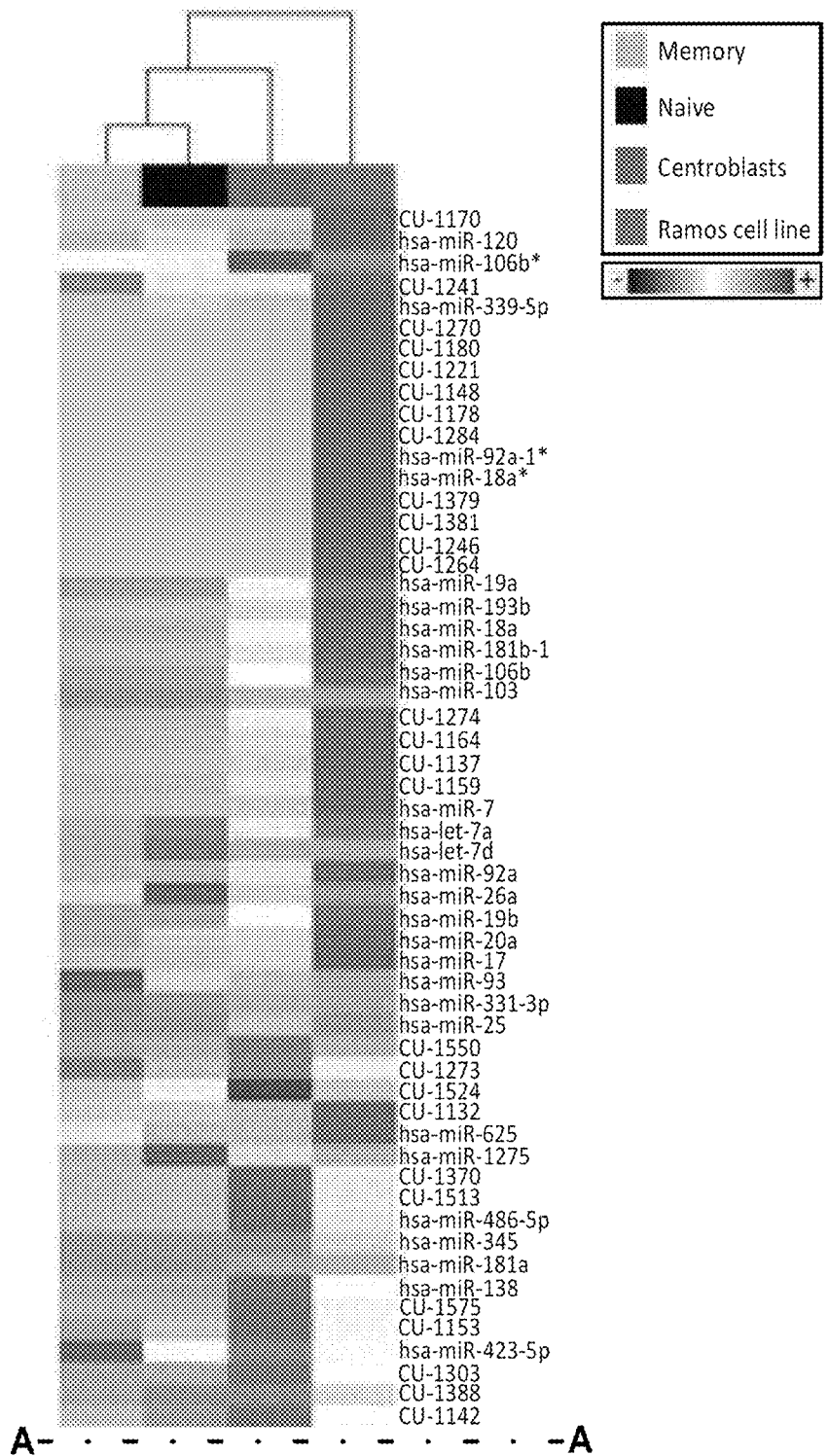
FIG. 15A(1)

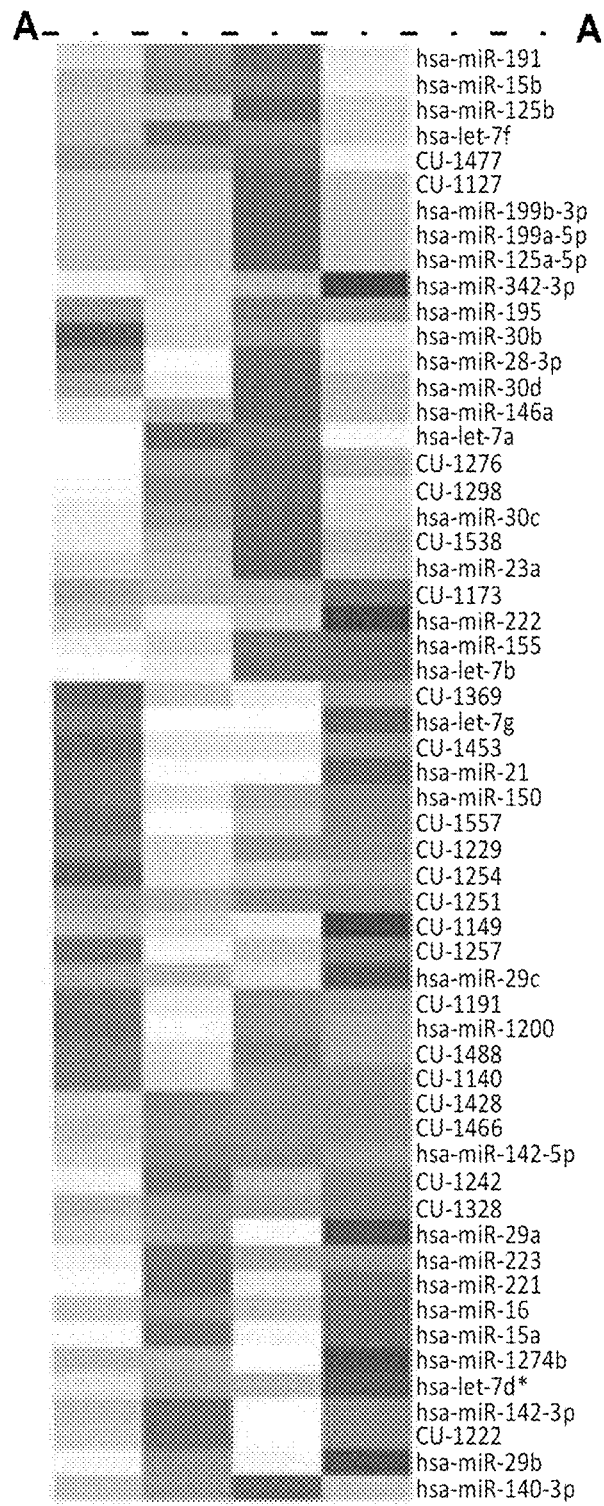
*FIG. 15A(2)*

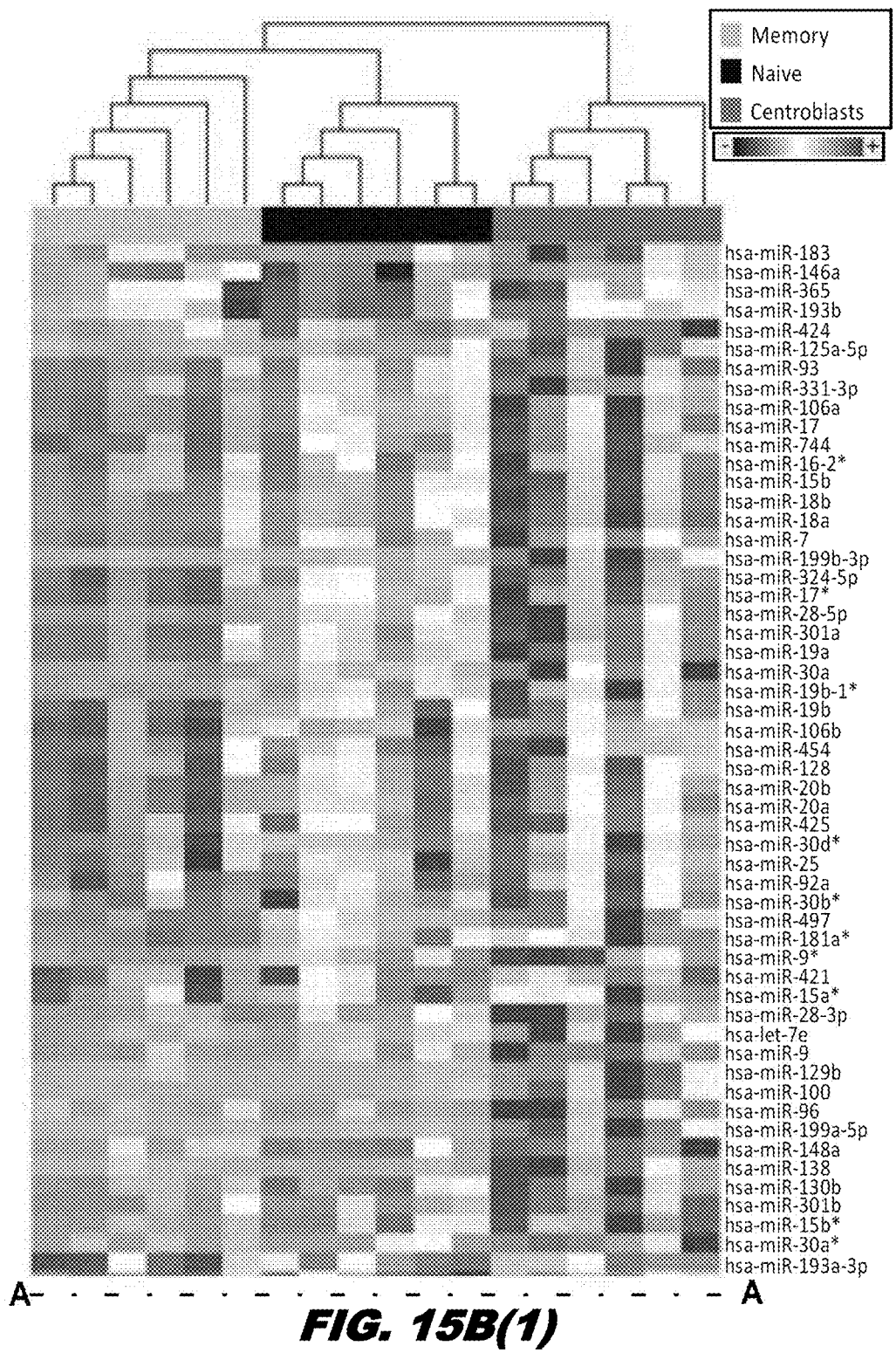
FIG. 15B(1)

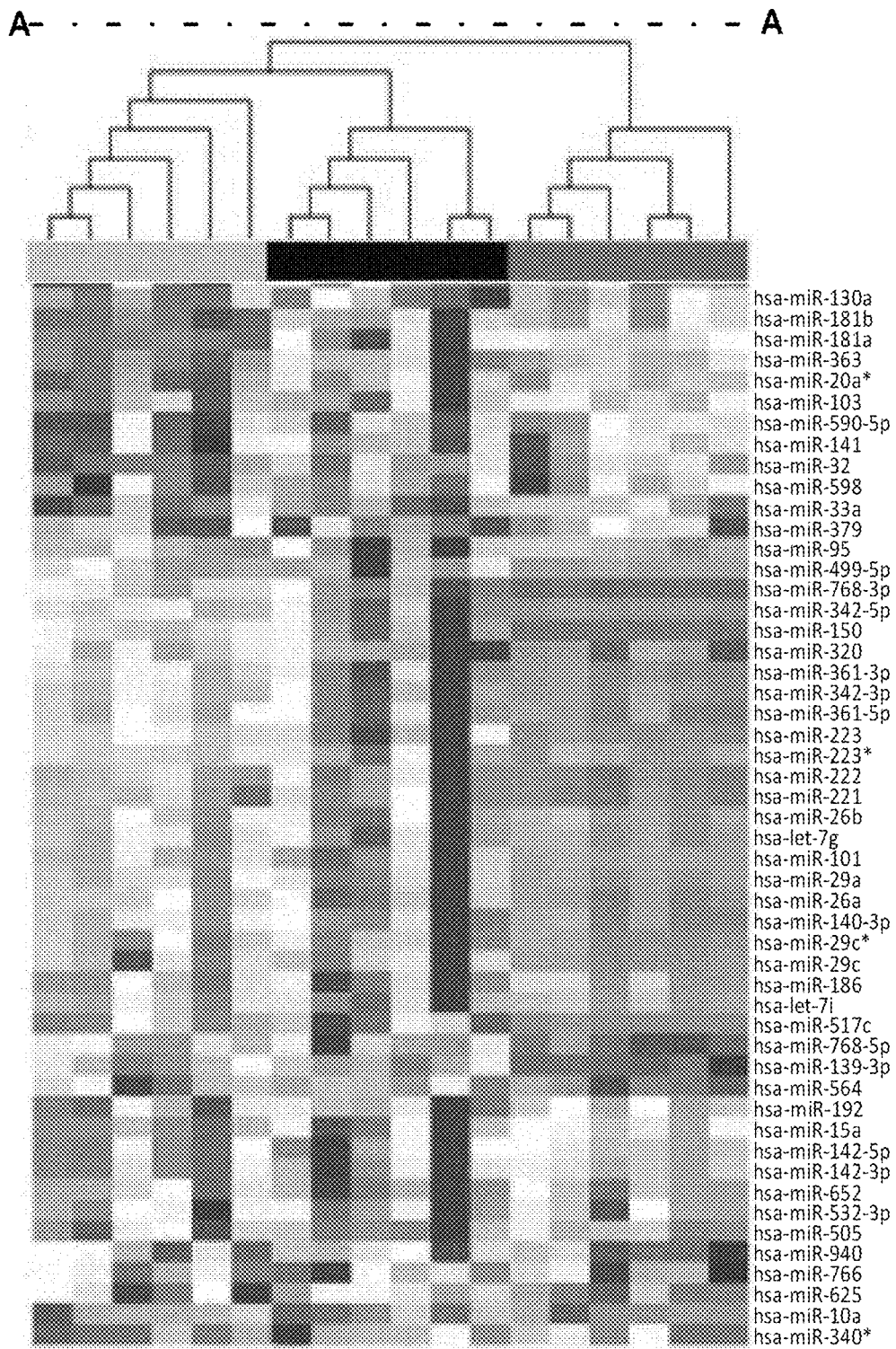
FIG. 15B(2)

| | Naive | Memory | Centroblasts | Ramos |
|---|---|---|---|---|
| Completeness | 84.0% | 87.2% | 86.8% | 85.8% |
| Estimated total mature miRNA | 188 | 211 | 219 | 225 |

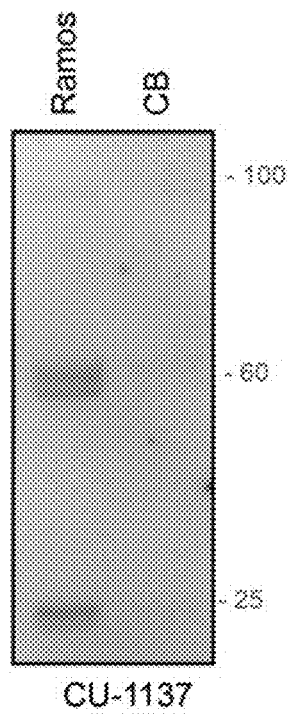
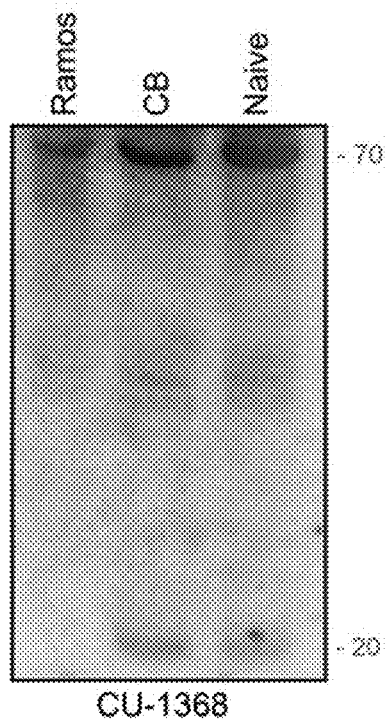
FIG. 21C

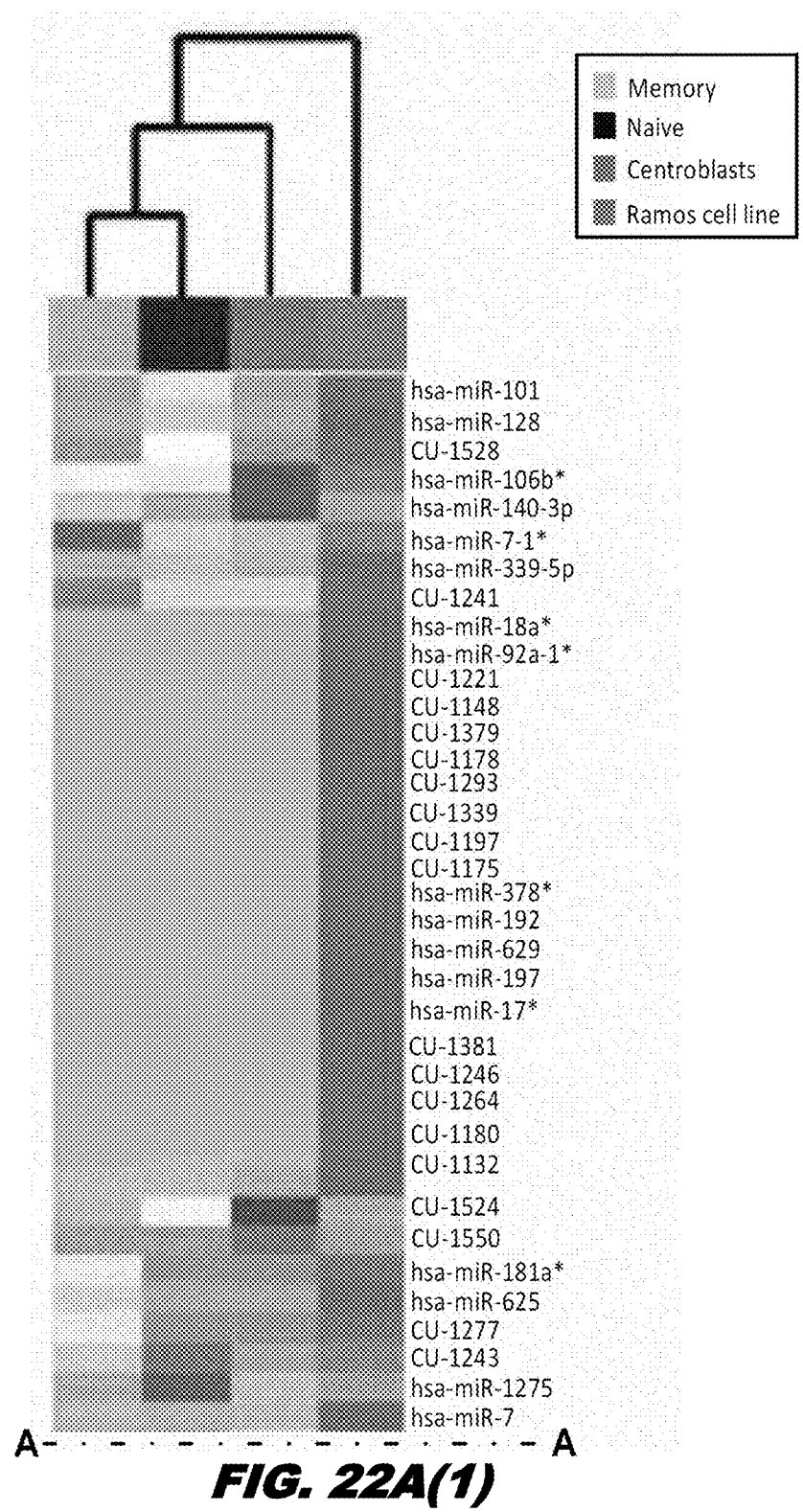
*FIG. 22A(1)*

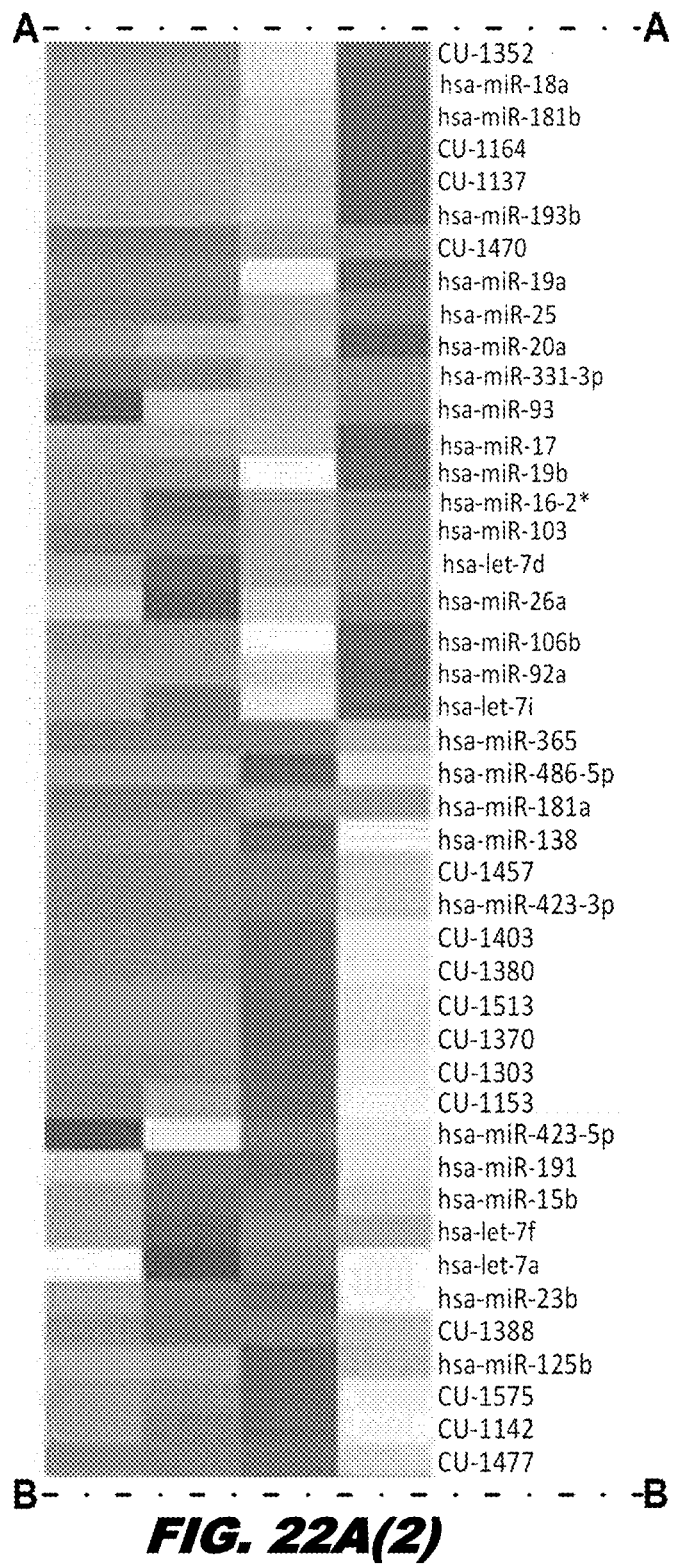
FIG. 22A(2)

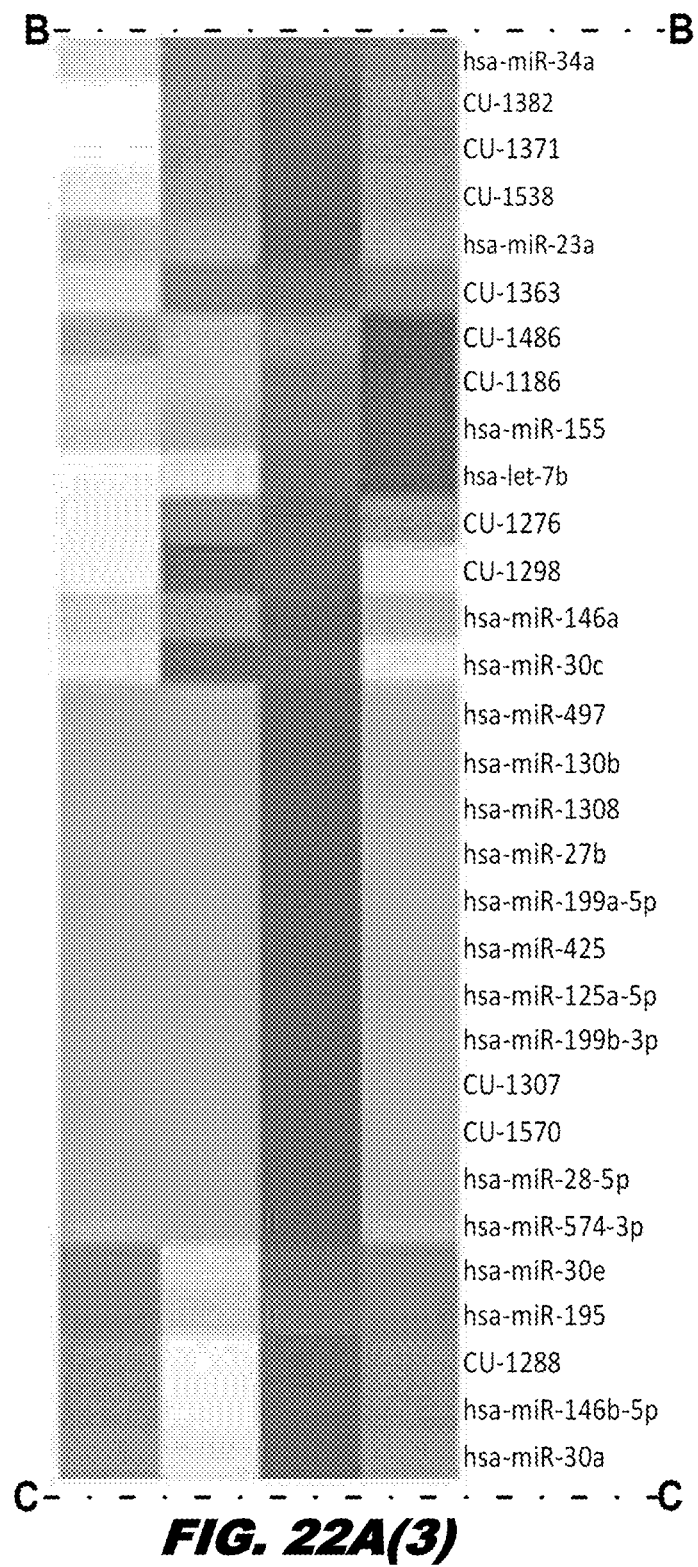
FIG. 22A(3)

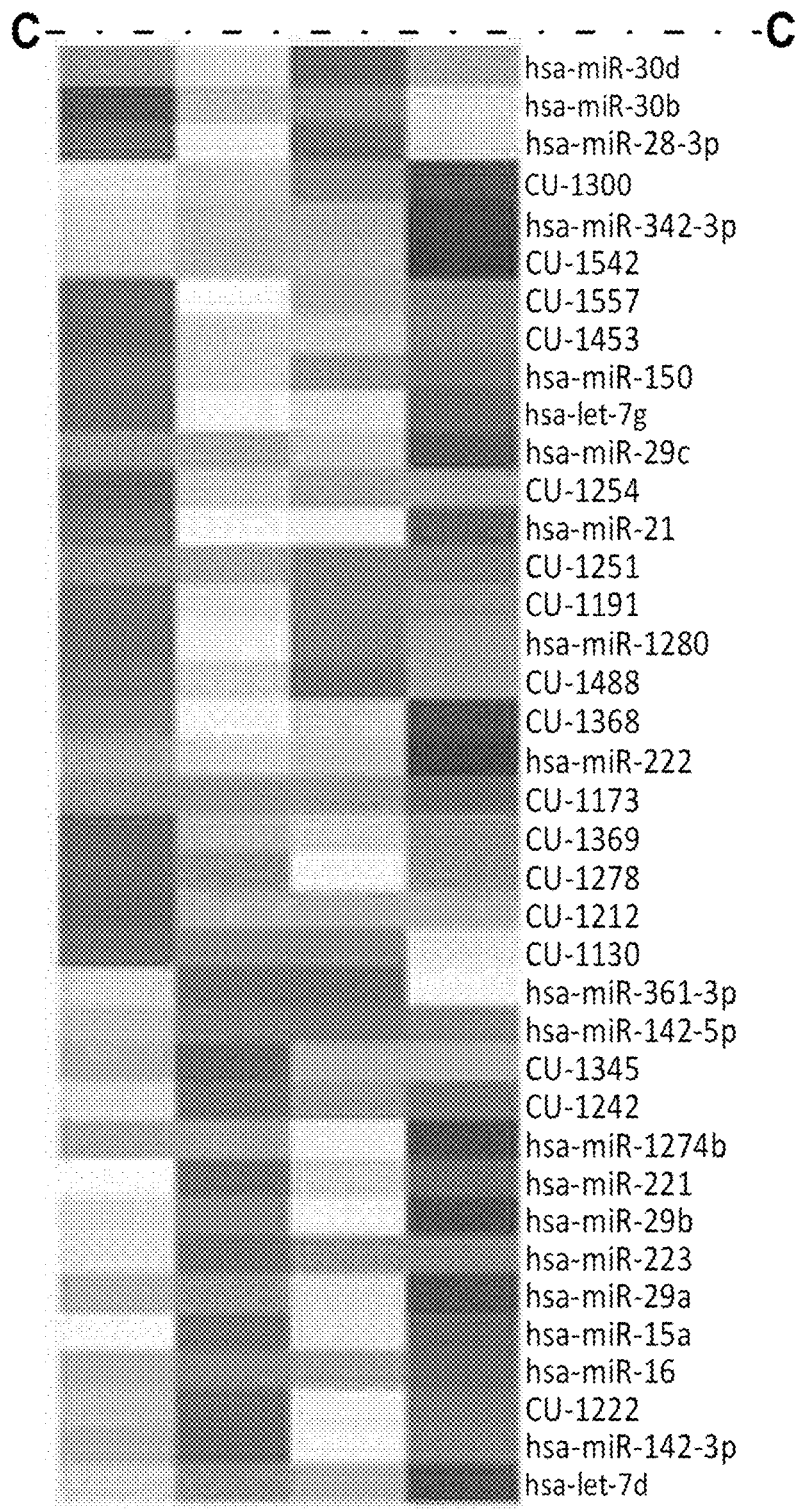
FIG. 22A(4)

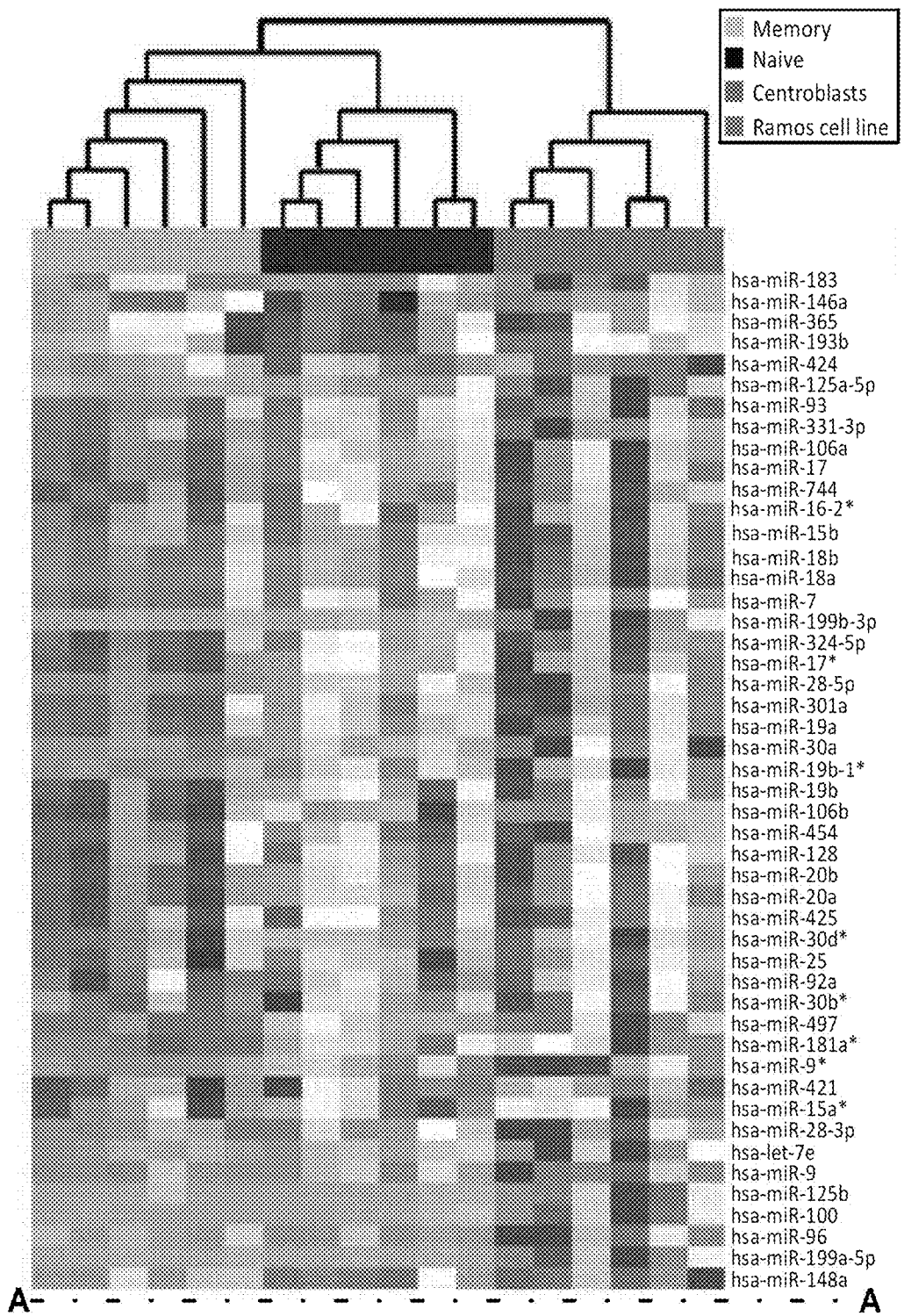
*FIG. 22B(1)*

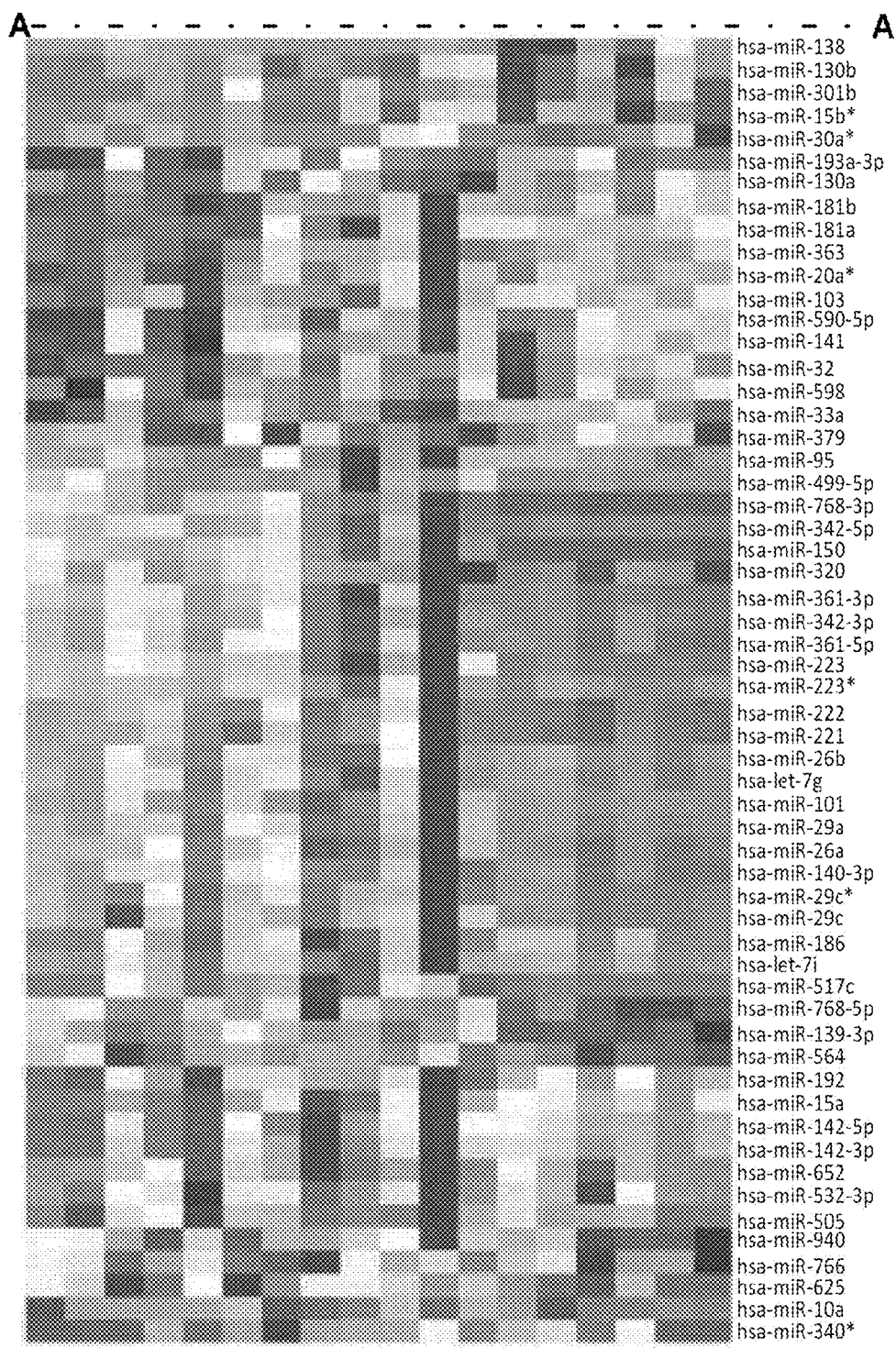
FIG. 22B(2)

US 8,586,726 B2

TISSUE-SPECIFIC MICRORNAS AND COMPOSITIONS AND USES THEREOF

This application is a Continuation-In-Part of International Patent Application No. PCT/US2008/070082, filed Jul. 15, 2008, which claims priority of U.S. Provisional Patent Application No. 60/950,474, filed Jul. 18, 2007, and of U.S. Provisional Patent Application No. 61/020,625, filed Jan. 11, 2008 each of which is incorporated herewith in its entirety.

GOVERNMENT INTERESTS

The work described herein was supported in whole, or in part, by National Cancer Institute Grant No. R01-CA109755 "Genetic Network Interference with Combinatorial Phenotypes", and National Institute of Allergy and Infectious Diseases Grant No. R01 AI066116 "Regulatory Modules in Normal and Transformed b-Cell". Thus, the United States Government has certain rights to the invention.

All patents, patent applications and publications cited herein are hereby incorporated by reference in their entirety. The disclosures of these publications in their entireties are hereby incorporated by reference into this application in order to more fully describe the state of the art as known to those skilled therein as of the date of the invention described and claimed herein.

This patent disclosure contains material that is subject to copyright protection. The copyright owner has no objection to the facsimile reproduction by anyone of the patent document or the patent disclosure as it appears in the U.S. Patent and Trademark Office patent file or records, but otherwise reserves any and all copyright rights.

SEQUENCE LISTING

The instant application contains a Sequence Listing which has been submitted via EFS-Web and is hereby incorporated by reference in its entirety. Said ASCII copy, created on Mar. 17, 2010, is named 19240US3.txt, and is 1,134,968 bytes in size.

LENGTHY TABLE

A lengthy table (for example, Table 11) is referenced in this application and has been filed as an Appendix to this invention. The specification of the application contains reference to the single table, Table 11, which consists of more than 51 pages, and is hereby incorporated by reference in its entirety. Table 11 contains information encompassing gene sequences pertaining to the analysis of cross-species conservation for miRNAs. The Table displays results for conservation of full-length mature miRNA sequences, and seed of the mature sequence.

BACKGROUND OF THE INVENTION

Various nucleic acid species are capable of modifying gene expression. These species include antisense RNA, siRNA, microRNA, RNA and DNA aptamers, anatgomirs, and decoy RNAs. Each of these nucleic acid species can inhibit target nucleic acid activity, including gene expression.

MicroRNAs (miRNAs, miR5) are 20-23 nucleotides (nt) RNA molecules that are produced by the processing of a larger enclosing stem-loop structure (>50 bp), called precursors, by cellular enzymes. miRNAs are processed from hairpin precursors of 70 nt (pre-miRNA) which are derived from primary transcripts (pri-miRNA) through sequential cleavage by the RNAse III enzymes drosha and dicer. miRNAs target the messenger RNA of other genes by binding to their 3' UTR and interfering with their translation or causing degradation by enzyme targeting double-stranded RNA. miRNAs are non-coding RNAs (ncRNAs) that exist in a variety of organisms, including mammals, and are conserved in evolution. Many miRNAs tend to be clustered and transcribed as polycistrons and often have similar spatial temporal expression patterns. miRNAs have been implicated in various biological processes including developmental timing, differentiation, apoptosis, cell proliferation, organ development, and metabolism

SUMMARY OF THE INVENTION

The invention is based, at least in part, on the discovery of newly-identified microRNAs from normal and tumor-related Human B cells. Accordingly, in one aspect, the invention features an isolated nucleic acid, wherein the nucleic acid: (a) consists of from about 14 to about 31 nucleotides in length; (b) exhibits expression in a human tissue; (c) has a nucleotide sequence not present in an exon; and (d) consists essentially of a nucleotide sequence selected from the group consisting of SEQ ID NOS: 1-130 and 1094, and a nucleotide sequence which is about 97%, about 98%, or about 99% identical to a nucleic acid sequence comprising any one of SEQ ID NOS: 1-130 and 1094. In one embodiment, the nucleic acid is single stranded. In another embodiment, the nucleic acid is double-stranded. In a further embodiment, the human tissue comprises a lymphocyte. In some embodiments, the human tissue is a B cell. In other embodiments, the B cell comprises a Naïve B cell, a centroblast, a memory B cell, or a Ramos Burkitt Lymphoma cell.

An aspect of the invention provides for an isolated nucleic acid, wherein the nucleic acid: (a) consists of from about 14 to about 31 nucleotides in length; (b) exhibits expression in a human tissue; (c) has a nucleotide sequence not present in an exon; and (d) consists essentially of a nucleotide sequence selected from the group consisting of SEQ ID NOS: 131-401, and a nucleotide sequence which is about 97%, about 98%, or about 99% identical to a nucleic acid sequence having a SEQ ID NO: 131-401. In one embodiment, the nucleic acid is single stranded. In another embodiment, the nucleic acid is double-stranded. In a further embodiment, the human tissue comprises a lymphocyte. In some embodiments, the human tissue is a B cell. In other embodiments, the B cell comprises a Naïve B cell, a centroblast, a memory B cell, or a Ramos Burkitt Lymphoma cell.

The invention provides for an isolated nucleic acid that is complementary to a nucleic acid described in the aspects herein. In one embodiment, the nucleic acid is single stranded. In another embodiment, the nucleic acid is double-stranded.

The invention provides for an isolated nucleic acid that is complementary to all but 1, 2, 3, 4, or 5 nucleotides of the nucleic acids described in the aspects herein. In one embodiment, the nucleic acid is complementary to at least 14, 15, 16, 17, 18, 19, 20, 21, 22, 23, 24, 25, 26, 27, 28, 29, 30, or 31 contiguous nucleotides of a nucleic acid described in the aspects herein consisting from about 14 to about 31 nucleotides in length. In one embodiment, the nucleic acid is single stranded. In another embodiment, the nucleic acid is double-stranded.

The invention provides for a composition comprising one or more nucleic acids of described in the aspects herein, in any combination or permutation thereof. In one embodiment, the composition further comprises one or more carriers, excipients, solvents, bases, or a combination thereof.

The invention provides for a composition comprising one or more nucleic acids, wherein the one or more nucleic acids consist essentially of a nucleotide sequence of any one of SEQ ID NOS: 1-401 and 1094. In one embodiment, the composition further comprises one or more carriers, excipients, solvents, bases, or a combination thereof.

The invention provides for a method for modulating the activity of a target nucleic acid in a cell, wherein the method comprises contacting a cell with a nucleic acid described in the aspects herein. In one embodiment, the target nucleic acid is a mRNA, a mature miRNA, or a precursor to a mature miRNA. In another embodiment, the cell is a hematopoetic cell. In a further embodiment, the cell is a B cell. In some embodiments, the cell is in vitro or in vivo.

BRIEF DESCRIPTION OF THE FIGURES

FIG. 13A is a line graph depicting the analysis of miRNA identified in B cells short-RNA libraries. It shows the previously reported (known) miRNA and newly identified (new) miRNAs as occurring in naïve, centroblasts, memory and Ramos cells.
FIG. 13B are schematics depicting number of miRNAs specifically or commonly identified in naïve, centroblasts and memory B cell short-RNA libraries. A larger overlap is observed for known compared to new miRNA (42% versus 15%).
FIG. 14 are photographs depicting the detection of miRNA by Northern Blot.
FIG. 15 is an image of a microarray-based miRNA expression profiling that distinguishes developmental stages of normal as well as malignant B cells.
FIG. 15A represents unsupervised clustering performed using miRNA frequencies values (>=0.16) calculated as the fraction of the total pool of cloned miRNAs represented by a given miRNA in a library.
FIG. 15A(1) and FIG. 15A(2) are joined at the hatched line (A-A) to comprise FIG. 15A.
FIG. 15B shows the Unsupervised clustering of microarray-based miRNA expression profiles distinguishes centroblasts, naïve and memory B cells purified from tonsil tissue of six patients/each.
FIG. 15B(1) and FIG. 15B(2) are joined at the hatched line (A-A) to comprise FIG. 15B.
FIG. 17(1) and FIG. 17(2) are joined at the hatched line (A-A) to comprise FIG. 17.
"
FIG. 20 shows graphs and charts pertaining to the abundance and evolutionary conservation of the B-cell miRNome.

Single occurrences miRNAs are not included.

FIG. 21 are photographs showing the detection of previously unreported miRNAs by RT-PCR and RNA blot. FIG. 21C are RNA blot images displaying both the mature (20-25 nt) and the precursor (60-80 nt) miRNA species. miRNA expression can be regulated at transcriptional level (top panel) or at the processing level (bottom panel) when intermediate forms (pre-miRNA) are generated but are not fully processed to mature miRNA. The naming of miRNAs is provisional.

FIG. 22 is a schematic that shows miRNA expression profiling distinguishes developmental stages of normal as well as malignant B cells. FIG. 22A depicts unsupervised clustering performed using miRNA frequencies values (≥0.08) calculated as the fraction of the total pool of cloned miRNAs represented by a given miRNA in a library. FIG. 22A(1) and FIG. 22A(2) are joined at the hatched line (A-A), FIG. 22A(2) and FIG. 22A(3) are joined at the hatched line (B-B), and FIG. 22A(3) and FIG. 22A(4) are joined at the hatched line (C-C) to comprise FIG. 22A. FIG. 22B shows unsupervised clustering of microarray-based miRNA expression profiles distinguishes centroblasts, naïve and memory B cells purified from tonsil tissue of six patients/each. FIG. 22B(1) and FIG. 22B(2) are joined at the hatched line (A-A) to comprise FIG. 22B.

DETAILED DESCRIPTION OF THE INVENTION

Figure 1:
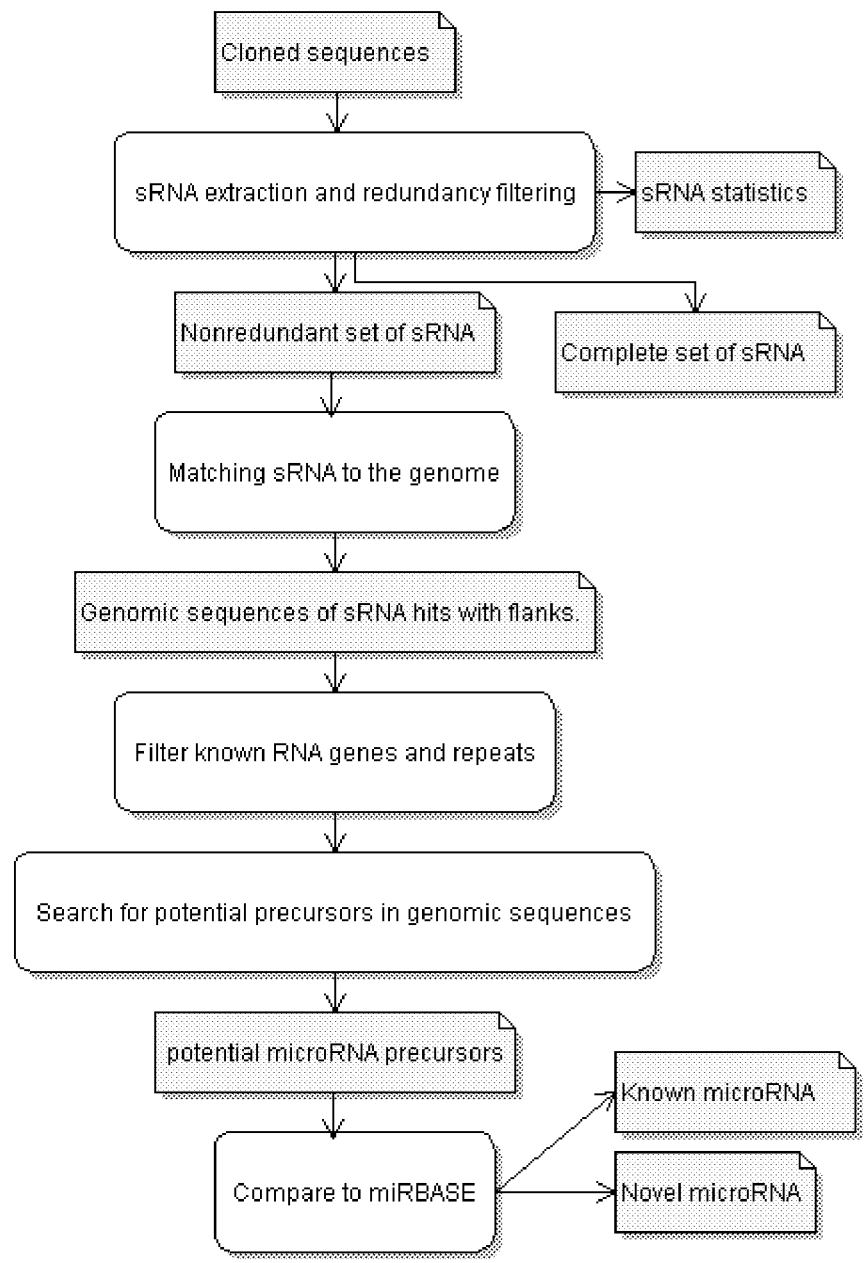
FIG. 1 is a flow diagram of a computational pipeline.

This invention provides for the discovery of a large number of new micro RNAs that have been identified to exist in normal Human B cells and/or in tumor-related Human B cells, using an integrated bioinformatics method and pipeline described herein.

Micro RNAs (miRNAs) are naturally-occurring 19 to 25 nucleotide transcripts found in over one hundred distinct organisms (such as nematodes, fruit flies, and humans). miRNAs can be processed from 60- to 70-nucleotide foldback RNA precursor structures, which are transcribed from the miRNA gene. The miRNA precursor processing reaction requires Dicer RNase III and Argonaute family members (Sasaki et al., 2003 Genomics 82, 323-330). The miRNA precursor or processed miRNA products are easily detected, and an alteration in the levels of these molecules within a cell can indicate a perturbation in the chromosomal region containing the miRNA gene.

At least 222 separate miRNA genes have been identified in the human genome. For example, 2 miRNA genes (miR15a and miR16a) have been localized to a homozygously deleted region on chromosome 13 that is correlated with chronic lymphocytic leukemia (Calin et al. (2002), Proc. Natl. Acad. Sci. USA 99:15524-29). However, the distribution of miRNA genes throughout the genome, and the relationship of the miRNA genes to diverse chromosomal features, has not been systematically studied. A further review of miRNAs is provided in U.S. Pat. No. 7,232,806, U.S. Patent Application Publication No. 2006/0105360, and in the references: Landgraf et al., 2007, *Cell* 129: 1401-1414; Mendell, J T, 2005 *Cell Cycle* 4(9):1179-84; Shivdasani R A, 2006 *Blood*

108(12):3646-53; Hwang and Mendell, 2006 *Br J Cancer* 94(6):776-80; Hammond S M, 2006; *Curr Opin Genet Dev.* 16(1):4-9; Osada and Takahashi, 2007 *Carcinogenesis* 28(1): 2-12; and Zhang et al., 2007 *Dev Biol.* 302(1):1-12, all of which are hereby incorporated by reference in their entirety.

All nucleic acid sequences herein are given in the 5' to 3' direction, for example the mature miRNA sequences listed in Table 1 (SEQ ID NOS: 1-401).

The unprocessed miRNA gene transcript is called a miRNA precursor (pre-miRNA) and comprises an RNA transcript of about 70 nucleotides in length. The pre-miRNA can be processed by digestion with an RNAse (such as, Dicer, Argonaut, or RNAse III, e.g., *E. coli* RNAse III)) into an active 19-25 nucleotide RNA molecule. This active 19-25 nucleotide RNA molecule is also called the processed miRNA gene transcript.

The active 19-25 nucleotide RNA molecule can be obtained from the miRNA precursor through natural processing routes (for example, using intact cells or cell lysates) or by synthetic processing routes (for example, using isolated processing enzymes, such as isolated Dicer, Argonaut, or RNAase III). The active 19-25 nucleotide RNA molecule can also be produced directly by biological or chemical syntheses, without having been processed from the miRNA precursor.

The invention provides for an isolated nucleic acid that: (a) consists of from about 14 to about 31 nucleotides in length; (b) exhibits expression in a human tissue; and (c) has a nucleotide sequence not present in an exon. In one embodiment, the isolated nucleic acid consists essentially of a nucleotide sequence selected from the group consisting of SEQ ID NOS: 1-401 and 1094, and a nucleotide sequence which is about 97%, about 98%, or about 99% identical to a nucleic acid sequence comprising any one of SEQ ID NOS: 1-401 and 1094. In some embodiments, the human tissue comprises a lymphocyte (for example, a human B cell). In other embodiments, the B cell comprises a Naïve B cell, a centroblast, or a memory B cell.

For example, an isolated nucleic acid, such as a miRNA of the invention, can be synthesized, or altered, or removed from the natural state through human intervention. A synthetic miRNA, or a miRNA partially or completely separated from the coexisting materials of its natural state, is considered isolated. An isolated miRNA can exist in substantially purified form, or can exist in a cell into which the miRNA has been delivered.

An isolated nucleic acid, such as a miRNA of the invention, can be obtained using a number of standard techniques utilized in the art. For example, the miRNA gene products can be chemically synthesized or recombinantly produced using methods known in the art. For example, a miRNA can be chemically synthesized using appropriately protected ribonucleoside phosphoramidites and a conventional DNA/RNA synthesizer. Commercial suppliers of synthetic RNA molecules or synthesis reagents include, e.g., Proligo (Hamburg, Germany), Dharmacon Research (Lafayette, Colo., USA), Rosetta Genomics (North Brunswick, N.J.), Pierce Chemical (part of Perbio Science, Rockford, Ill., USA), Glen Research (Sterling, Va., USA), ChemGenes (Ashland, Mass., USA), Ambion (Foster City, Calif., USA), and Cruachem (Glasgow, UK).

miRNA can also be expressed from recombinant circular or linear DNA plasmids using any suitable promoter. Suitable promoters for expressing RNA from a plasmid include, e.g., the U6 or H1 RNA pol III promoter sequences, or the cytomegalovirus promoters. Selection of other suitable promoters is within the skill in the art. Recombinant plasmids can comprise inducible or regulatable promoters for expression of the miRNA in cancer cells (such as hematopoietic cells, i.e., B cells). For example, a miRNA or a precursor miRNA of the invention (such as a miRNA molecule comprising any one of SEQ ID NOS: 1-401 and 1094) can be placed under the control of the CMV intermediate-early promoter, whereby the nucleic acid sequences encoding the miRNA molecule are located 3' of the promoter, so that the promoter can initiate transcription of the miRNA gene product coding sequences.

miRNAs expressed from recombinant plasmids can be isolated from cultured cell expression systems by standard techniques. miRNAs which are expressed from recombinant plasmids can also be delivered to, and expressed directly in, the cancer cells. A miRNA can be expressed as an RNA precursor molecule from a single plasmid, and the precursor molecules are subsequently processed into functional miRNAs by a suitable processing system, including the processing systems naturally existing within a cell. Other suitable processing systems include, e.g., the in vitro *Drosophila* cell lysate system as described in U.S. Application Publication No. 2002/0086356 to Tuschl et al. and the *E. coli* RNAse III system described in U.S. Application Publication No. 2004/0014113 to Yang et al., which are herein incorporated by reference in their entireties.

Plasmids suitable for expressing a miRNA of the invention, methods for inserting nucleic acid sequences into the plasmid to express the miRNA of interest, and methods of delivering the recombinant plasmid to cells of interest are well-established and practiced in the art. See, for example, Zeng et al. (2002), *Molecular Cell* 9:1327-1333; Tuschl (2002), *Nat. Biotechnol,* 20:446-448; Brummelkamp et al. (2002), *Science* 296:550-553; Miyagishi et al. (2002), *Nat. Biotechnol.* 20:497-500; Paddison et al. (2002), *Genes Dev.* 16:948-958; Lee et al. (2002), *Nat. Biotechnol.* 20:500-505; and Paul et al. (2002), *Nat. Biotechnol.* 20:505-508, the entire disclosures of which are herein incorporated by reference.

miRNA molecules of the invention can also be expressed from recombinant viral vectors. The RNA expressed from the recombinant viral vectors can either be isolated from cultured cell expression systems by standard techniques, or can be expressed directly in cancer cells (such as hematopoietic cells, i.e., B cells). For example, the recombinant viral vectors can comprise sequences that encode the miRNA molecule of interest and any suitable promoter for expressing the RNA sequences. Vectors can also comprise inducible or regulatable promoters for expression of the miRNA molecule in cells, such as cancer cell. As discussed previously, non-limiting examples of suitable promoters include the U6 or H1 RNA pol III promoter sequences, or the cytomegalovirus promoters. Selection of other suitable promoters is practiced by those of ordinary skill in the art.

Any viral vector that can harbor the nucleotide sequences for the miRNA molecules of the invention can be used. Non-limiting examples of such vectors include: vectors derived from adenovirus (AV); adeno-associated virus (AAV); retroviruses (e.g., lentiviruses (LV), Rhabdoviruses, murine leukemia virus); herpes virus, and the like. The tropism of the viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. For example, AAV vectors can be made to target different cells by engineering the vectors to express different capsid protein serotypes. An AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J. E. et al. (2002), *J Virol* 76:791-801, the entire disclosure of which is herein incorporated by reference.

Recombinant viral vectors suitable for expressing miRNA molecules of the invention, methods for inserting nucleic acid sequences for expressing RNA in the vector, methods of delivering the viral vector to cells of interest, and recovery of the expressed RNA molecules are within the skill in the art. See, for example, Dornburg (1995), *Gene Therap.* 2:301-310; Eglitis (1988), *Biotechniques* 6:608-614; Miller (1990), *Hum. Gene Therap.* 1:5-14; and Anderson (1998), *Nature* 392:25-30, the entire disclosures of which are herein incorporated by reference. Useful viral vectors can be those derived from AV and AAV. A suitable AV vector for expressing a mRNA molecule of the invention, a method for constructing the recombinant AV vector, and a method for delivering the vector into target cells, are described in Xia et al. (2002), *Nat. Biotech.* 20:1006-1010, the entire disclosure of which is herein incorporated by reference. Suitable AAV vectors for expressing a miRNA molecule having a sequence shown in Table 1 (i.e., any one of SEQ ID NOS: 1-401), methods for constructing the recombinant AAV vector, and methods for delivering the vectors into target cells are described in Samulski et al. (1987), *J. Virol.* 61:3096-3101; Fisher et al. (1996), *J. Virol.,* 70:520-532; Samulski et al. (1989), *J. Virol.* 63:3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

Inhibition of RNA can effectively inhibit expression of a gene from which the RNA is transcribed. Inhibitors are selected from the group comprising: siRNA; interfering RNA or RNAi; dsRNA; RNA Polymerase III transcribed DNAs; ribozymes; and antisense nucleic acid, which can be RNA, DNA, or artificial nucleic acid. Also within the scope of the present invention are oligonucleotide sequences that include antisense oligonucleotides, antagomirs (also referred to as miRNA inhibitory nucleic acids), aptamers, and ribozymes that function to inhibit miRNA expression via purportedly binding to or degrading a miRNA molecule comprising any one of SEQ ID NOS: 1-401 and 1094.

The invention provides for a nucleic acid molecule that is substantially complementary to an isolated nucleic acid of the invention described above. "Substantially complementary" means that two sequences are substantially complementary that a duplex can be formed between them. The duplex can have one or more mismatches but the region of duplex formation is sufficient to down-regulate expression of the target nucleic acid. The region of substantial complementarity can be perfectly paired. In one embodiment, there can be nucleotide mismatches in the region of substantial complementarity. In one embodiment, the region of substantial complementarity will have no more than 1, 2, 3, 4, or 5 mismatches.

For example, an antagomir, an antisense RNA, a small interfering RNA (siRNA), a short hairpin RNA (snRNA), and the like) can be complementary to the guide strand of a miRNA having a nucleotide sequence shown in Table 1, positioned in the RNA silencing complex. This nucleic acid molecule can be single stranded or can be double stranded, and can inhibit the expression or activity of a miRNA molecule of the invention. In one embodiment, the nucleic acid molecule that inhibits a miRNA molecule of the invention (such as those described above) can complement at least 14, 15, 16, 17, 18, 19, 20, 21, 22, 23, 24, 25, 26, 27, 28, 29, 30, or 31 contiguous nucleotides of a miRNA having a nucleic acid sequence selected from the group consisting of SEQ ID NOS: 1-401 and 1094, and a nucleotide sequence which is about 97%, about 98%, or about 99% identical to a nucleic acid sequence comprising any one of SEQ ID NOS: 1-401 and 1094.

The invention also provides a method for modulating a target nucleic acid in a cell (for example, a miRNA molecule having a nucleotide sequence comprising any one of SEQ ID NOS: 1-401 and 1094) via contacting the cell with a nucleic acid of the invention (for example, those described above). For example, the nucleic acid can be substantially complementary to at least 14, 15, 16, 17, 18, 19, 20, 21, 22, 23, 24, 25, 26, 27, 28, 29, 30, or 31 contiguous nucleotides of a nucleic acid sequence selected from the group consisting of SEQ ID NOS: 1-401 and 1094, and a nucleotide sequence which is about 97%, about 98%, or about 99% identical to a nucleic acid sequence comprising any one of SEQ ID NOS: 1-401 and 1094.

Expression of a miRNA molecule of the invention can be inhibited by an antisense oligonucleotide. Antisense oligonucleotides can comprise antisense DNA, RNA, and DNA/RNA molecule and act via altering the activity of the target RNA by binding to a target nucleic acid (such as a miRNA of interest) by means of RNA-RNA, RNA-DNA or RNA-PNA (protein nucleic acid) interactions (for a review, see Stein and Cheng, 1993 Science 261, 1004 and Woolf et al., U.S. Pat. No. 5,849,902). Antisense oligonucleotides suitable for use in the present methods are single-stranded nucleic acids (e.g., RNA, DNA, RNA-DNA chimeras, PNA) that generally comprise a nucleic acid sequence complementary to a contiguous nucleic acid sequence in a miRNA molecule. For example, the antisense oligonucleotide comprises a nucleic acid sequence that is 50-100% complementary, 75-100% complementary, or 95-100% complementary to a contiguous nucleic acid sequence in a miRNA molecule of the invention having a nucleic acid sequence of SEQ ID NO: 1-401, shown in Table 1. However, in some instances, an antisense molecule can form a loop and binds to a substrate nucleic acid which forms a loop. Thus, an antisense molecule can be complementary to two (or more) non-contiguous substrate sequences, or two (or more) non-contiguous sequence portions of an antisense molecule can be complementary to a target sequence, or both. For a review of current antisense strategies, see Schmajuk et al., 1999, *J. Biol. Chem.,* 274, 21783-21789; Delihas et al., 1997, *Nature,* 15, 751-753; Stein et al., 1997, *Antisense N A. Drug Dev.,* 7, 151; Crooke, 2000, *Methods Enzymol.,* 313, 3-45; Crooke, 1998, *Biotech. Genet. Eng. Rev.,* 15, 121-157; Crooke, 1997, *Ad. Pharmacol.,* 40, 1-49.

Antisense DNA can also be used to target nucleic acid by means of DNA-RNA interactions, thereby activating RNase H, which digests the target nucleic acid in the duplex. The antisense oligonucleotides can comprise one or more RNAse H activating region, which is capable of activating RNAse H to cleave a target nucleic acid. Antisense DNA can be synthesized chemically or expressed via the use of a single stranded DNA expression vector or equivalent thereof. An RNase H activating region refers to a region (generally greater than or equal to 4-25 nucleotides in length, for example, from 5-11 nucleotides in length) of a nucleic acid compound capable of binding to a target nucleic acid to form a non-covalent complex that is recognized by cellular RNase H enzyme (see for example Arrow et al., U.S. Pat. No. 5,849,902; Arrow et al., U.S. Pat. No. 5,989,912). The RNase H enzyme binds to a nucleic acid compound-target nucleic acid complex and cleaves the target nucleic acid sequence.

Antisense nucleic acids can be produced chemically or biologically, or can be expressed from a recombinant plasmid or viral vector, as described above for the isolated miRNA molecules. For example, antisense oligonucleotides of at least about 15 bases and complementary to unique regions of the miRNA molecules of the invention can be synthesized, e.g., by conventional phosphodiester techniques (Dallas et al., (2006) *Med. Sci. Monit.* 12(4):RA67-74; Kalota et al., (2006) *Handb. Exp. Pharmacol.* 173:173-96; Lutzelburger et al., (2006) *Handb. Exp. Pharmacol.* 173:243-59). Exemplary methods for producing and testing are within the skill in the art; see, e.g., Stein and Cheng (1993), *Science* 261:1004 and U.S. Pat. No. 5,849,902 to Woolf et al., the entire disclosures of which are herein incorporated by reference.

Antisense polynucleotides include, but are not limited to: morpholinos, 2'-O-methyl polynucleotides, DNA, RNA and the like. RNA polymerase III transcribed DNAs contain promoters, such as the U6 promoter. These DNAs can be transcribed to produce small hairpin RNAs in the cell that can function as siRNA or linear RNAs that can function as antisense RNA. The inhibitor can be polymerized in vitro, recombinant RNA, contain chimeric sequences, or derivatives of these groups. The inhibitor can contain ribonucleotides, deoxyribonucleotides, synthetic nucleotides, or any suitable combination such that the target RNA and/or gene is inhibited. In addition, these forms of nucleic acid can be single, double, triple, or quadruple stranded. (see for example Bass (2001) *Nature,* 411, 428 429; Elbashir et al., (2001) *Nature,* 411, 494 498; and PCT Publication Nos. WO 00/44895, WO 01/36646, WO 99/32619, WO 00/01846, WO 01/29058, WO 99/07409, WO 00/44914).

siRNA comprises a double stranded structure that can contain 15 to 50 base pairs, or 21 to 25 base pairs, and having a nucleotide sequence identical or nearly identical to an expressed target gene or RNA within the cell. The siRNA comprise a sense RNA strand and a complementary antisense RNA strand annealed together by standard Watson-Crick base-pairing interactions. The sense strand comprises a nucleic acid sequence which is substantially identical to a nucleic acid sequence contained within the target miRNA molecule. "Substantially identical" to a target sequence contained within the target mRNA refers to a nucleic acid sequence that is identical to the target sequence, or that differs from the target sequence by one or two nucleotides. The sense and antisense strands of the siRNA can comprise two complementary, single-stranded RNA molecules, or can comprise a single molecule in which two complementary portions are base-paired and are covalently linked by a single-stranded "hairpin" area.

The siRNA can also be altered RNA that differs from naturally-occurring RNA by the addition, deletion, substitution and/or alteration of one or more nucleotides. Such alterations can include addition of non-nucleotide material, such as to the end(s) of the siRNA or to one or more internal nucleotides of the siRNA, or modifications that make the siRNA resistant to nuclease digestion, or the substitution of one or more nucleotides in the siRNA with deoxyribonucleotides. One or both strands of the siRNA can also comprise a 3' overhang. As used herein, a 3' overhang refers to at least one unpaired nucleotide extending from the 3'-end of a duplexed RNA strand. For example, the siRNA can comprise at least one 3' overhang of from 1 to about 6 nucleotides (which includes ribonucleotides or deoxyribonucleotides) in length, or from 1 to about 5 nucleotides in length, or from 1 to about 4 nucleotides in length, or from about 2 to about 4 nucleotides in length. For example, each strand of the siRNA can comprise 3' overhangs of dithymidylic acid ("TT") or diuridylic acid ("uu").

siRNA can be produced chemically or biologically, or can be expressed from a recombinant plasmid or viral vector, as described above for the miRNA molecules of the invention having a sequence shown in Table 1. Exemplary methods for producing and testing dsRNA or siRNA molecules are described in U.S. Patent Application Publication No. 2002/0173478 to Gewirtz, U.S. Patent Application Publication No. 2007/0072204 to Hannon et al., and in U.S. Patent Application Publication No. 2004/0018176 to Reich et al., the entire disclosures of which are herein incorporated by reference.

Expression of a miRNA molecule of the invention can also be inhibited by a short hairpin RNA (shRNA). The hairpin RNAs can be synthesized exogenously or can be formed by transcribing from RNA polymerase III promoters in vivo. Examples of making and using such hairpin RNAs for gene silencing in mammalian cells are described in, for example, Paddison et al., 2002, *Genes Dev,* 16:948-58; McCaffrey et al., 2002, *Nature,* 418:38-9; McManus et al., 2002, *RNA,* 8:842-50; Yu et al., 2002, *Proc Natl Acad Sci USA,* 99:6047-52). Such hairpin RNAs are engineered in cells or in an animal to ensure continuous and stable suppression of a desired gene. It is known in the art that siRNAs can be produced by processing a hairpin RNA in the cell.

Expression of a miRNA molecule of the invention can also be inhibited by a ribozyme. Ribozymes are enzymatic RNA molecules capable of catalyzing the specific cleavage of RNA. The mechanism of ribozyme action involves sequence specific hybridization of the ribozyme molecule to complementary target RNA sequences (for example those shown in Table 1), followed by endonucleolytic cleavage. Engineered hammerhead motif ribozyme molecules that specifically and efficiently catalyze endonucleolytic cleavage of a miRNA sequence shown in Table 1, are also within the scope of the present invention. Scanning the target molecule for ribozyme cleavage sites that include the following sequences, GUA, GUU, and GUC initially identifies specific ribozyme cleavage sites within any potential RNA target. Once identified, short RNA sequences of between about 15 and 20 ribonucleotides corresponding to the region of the target gene containing the cleavage site can be evaluated for predicted structural features such as secondary structure that can render the oligonucleotide sequence unsuitable.

The suitability of candidate targets can also be evaluated by testing their accessibility to hybridization with complementary oligonucleotides using, e.g., ribonuclease protection assays (see Romkes et al., 2005, *Methods Mol. Biol.;* 291: 387-98; Dvorak et al., 2003, *Biomed Pap Med Fac Univ Palacky Olomouc Czech Repub* 147(2):131-5). The construction and production of hammerhead ribozymes is well known in the art and is described more fully in Haseloff and Gerlach, 1988, *Nature,* 334:585-591. Ribozymes can also include RNA endoribonucleases such as the one which occurs naturally in Tetrahymena thermophila (known as the IVS or L-19 IVS RNA) and which has been described (see, e.g., Zaug, et al., 1984, *Science,* 224:574-578; Zaug and Cech, 1986, *Science,* 231:470-475; Zaug, et al., 1986, *Nature,* 324:429-433; published International patent application No. WO88/04300 by University Patents Inc.; Been and Cech, 1986, *Cell,* 47:207-216).

Both the antisense oligonucleotides and ribozymes of the present invention can be prepared by known methods. These include techniques for chemical synthesis such as, e.g., by solid phase phosphoamite chemical synthesis. Alternatively, antisense RNA molecules can be generated by in vitro or in vivo transcription of DNA sequences encoding the RNA molecule. Such DNA sequences can be incorporated into a wide variety of vectors that incorporate suitable RNA polymerase promoters such as the T7 or SP6 polymerase promoters.

Alternatively, expression of a miRNA molecule of the invention can be inhibited by an antagomir. An antagomir is a single-stranded, double stranded, partially double stranded or hairpin structured chemically modified oligonucleotide agent that comprises at least 12 or more contiguous nucleotides substantially complementary to an endogenous miRNA or agents that include 12 or more contiguous nucleotides substantially complementary to a target sequence of an miRNA or pre-miRNA nucleotide sequence. The antagomir can be RNA, DNA, or a combination of RNA and DNA, an is antisense with respect to its target nucleotide sequence. An antagomir can target RNA, e.g., an endogenous pre-miRNA or miRNA of the subject. For example, the antagomir can target a miRNA having a nucleic acid sequence shown in Table 1. Exemplary methods for producing and testing antagomirs are discussed in U.S. Patent Application Publication No. 2007/0123482 and U.S. Patent Application Publication No. 005/0182005, in addition to Mattes et al., 2007 *Am J Resp Cell Mol Biol* 36: 8-12; Krützfeldt et al., 2007 *Nuc Acid Res* 35(9): 2885-2892, which are all incorporated by reference in their entireties.

Various modifications to the nucleic acid molecules of the present invention can be introduced as a means of increasing intracellular stability and half-life. Some modifications include but are not limited to the addition of flanking sequences of ribonucleotides or deoxyribonucleotides to the 5' and/or 3' ends of the molecule, or the use of phosphorothioate or 2'-O-methyl rather than phosphodiesterase linkages within the oligonucleotide backbone.

Expression of a miRNA molecule of the invention can be inhibited by an aptamer. Aptamer nucleic acid sequences are readily made that bind to a wide variety of target molecules. The aptamer nucleic acid sequences of the invention can be comprised entirely of RNA or partially of RNA, or entirely or partially of DNA and/or other nucleotide analogs. A nucleic acid aptamer is a nucleic acid or a nucleic acid-like molecule that is capable of binding to a specific molecule of interest with high affinity and specificity. A nucleic acid aptamer also can be a nucleic acid molecule that mimics the three dimensional structure of active portions of miRNAs. A nucleic acid-aptamer can be between about 9 and about 300 nucleotides or the like in length. More commonly, an aptamer is between about 30 and about 100 nucleotides or the like in length.

Aptamers are developed to bind specific ligands by employing known in vivo or in vitro selection techniques known as SELEX (Systematic Evolution of Ligands by Exponential Enrichment). Nucleic acid-aptamers can be prepared by any known method, including synthetic, recombinant, and purification methods. Such methods are described in, for example, Ellington and Szostak (1990) *Nature* 346:818, Tuerk and Gold (1990) *Science* 249:505, James W., (2001) *Current Opinion in Pharmacology,* 1:540-546, Colas et al., (1996) *Nature* 380:548-550, U.S. Pat. No. 5,582,981; PCT Publication No. WO 00/20040; U.S. Pat. No. 5,270,163; Lorsch and Szostak (1994) *Biochem.* 33:973; Mannironi et al., (1997) *Biochem.* 36:9726; Blind (1999) *Proc. Nat'l. Acad. Sci. USA* 96:3606-3610; Huizenga and Szostak (1995) *Biochem.* 34:656-665; PCT Publication Nos. WO 99/54506, WO 99/27133, and WO 97/42317; and U.S. Pat. No. 5,756,291, all of which are incorporated by reference in their entireties.

Expression of a given miRNA molecule can be inhibited or decreased by inducing RNA interference of the miRNA molecule with an isolated double-stranded or single-stranded RNA molecule. For example, the miRNA inhibitor molecule can be those molecules discussed above, such as an antagomir, an antisense RNA, a small interfering RNA (siRNA), a short hairpin RNA (snRNA), and the like) which has at least about 75%, 80%, 90%, 95%, 98%, 99% or 100%, sequence homology to a portion of a miRNA molecule having a sequence shown in Table 1. For further discussion of modulation of miRNA expression, see: Lu et al., (2005) *Adv Genet.* 54:117-42; Leung and Whittaker (2005) *Pharmacol Ther.* 107(2):222-39; Takeshita and Ochiva (2006) *Cancer Sci.* 97(8):689-96; and Alexander et al., (2007) *Arch Immunol Ther Exp* (Warsz). 2007 May-June; 55(3):139-49.

A subject in need thereof, according to the invention, can refer to any animal classified as a mammal, including humans, domestic and farm animals, and zoo, sports, or pet animals. In some embodiments, the subject can be a mouse, a rat, a bird, a dog, a cat, a cow, a horse, a sheep, or a pig. In exemplary embodiments, a mammal is a human.

Methods for determining RNA expression levels in cells from a biological sample are within the level of skill in the art. For example, tissue sample can be removed from a subject suspected of having cancer associated with a cancer-associated chromosomal feature by conventional biopsy techniques. In another example, a blood sample can be removed from the subject, and white blood cells isolated for DNA extraction by standard techniques. The blood or tissue sample should be obtained from the subject prior to initiation of radiotherapy, chemotherapy or other therapeutic treatment. A corresponding control tissue or blood sample can be obtained from unaffected tissues of the subject, from a normal human individual or population of normal individuals, or from cultured cells corresponding to the majority of cells in the subject's sample. The control tissue or blood sample is then processed along with the sample from the subject, so that the levels of miRNA molecules in cells from the subject's sample can be compared to the corresponding miRNA molecule levels from cells of the control sample. For example, the relative miRNA expression in the control and normal samples can be conveniently determined with respect to one or more RNA expression standards. The standards can comprise, for example, a zero miRNA expression level, the miRNA expression level in a standard cell line, or the average level of miRNA expression previously obtained for a population of normal human controls.

Suitable techniques for determining the level of RNA transcripts of a gene of interest in cells are within the skill in the art. According to one such method, total cellular RNA can be purified from cells by homogenization in the presence of nucleic acid extraction buffer, followed by centrifugation. Nucleic acids are precipitated, and DNA is removed by treatment with DNase and precipitation. The RNA molecules are then separated by gel electrophoresis on agarose gels according to standard techniques, and transferred to nitrocellulose filters by, e.g., the so-called "Northern" blotting technique. The RNA is then immobilized on the filters by heating. Detection and quantification of specific RNA is accomplished using appropriately labeled DNA or RNA probes complementary to the RNA in question. See, for example, *Molecular Cloning: A Laboratory Manual*, J. Sambrook et al., eds., 2nd edition, Cold Spring Harbor Laboratory Press, 1989, Chapter 7, the entire disclosure of which is incorporated by reference.

Suitable probes for Northern blot hybridization of a given miRNA molecule can be produced from the nucleic acid sequences provided in Table 1. Methods for preparation of labeled DNA and RNA probes, and the conditions for hybridization thereof to target nucleotide sequences, are described in *Molecular Cloning: A Laboratory Manual*, J. Sambrook et al., eds., 2nd edition, Cold Spring Harbor Laboratory Press, 1989, Chapters 10 and 11, the disclosures of which are herein incorporated by reference. For example, the nucleic acid probe can be labeled with, e.g., a radionuclide such as $^3$H, $^{32}$P, $^{33}$P, $^{14}$C, or $^{35}$S; a heavy metal; or a ligand capable of functioning as a specific binding pair member for a labeled ligand (e.g., biotin, avidin or an antibody), a fluorescent molecule, a chemiluminescent molecule, an enzyme or the like.

Probes can be labeled to high specific activity by either the nick translation method of Rigby et al. (1977), *J. Mol. Biol.* 113:237-251 or by the random priming method of Fienberg et al. (1983), *Anal. Biochem.* 132:6-13, the entire disclosures of which are herein incorporated by reference. Fienberg et al. provides a useful method for synthesizing $^{32}$P-labeled probes of high specific activity from single-stranded DNA or from RNA templates. For example, by replacing preexisting nucleotides with highly radioactive nucleotides according to the nick translation method, $^{32}$P-labeled nucleic acid probes can be prepared with a specific activity well in excess of $10^8$ cpm/microgram. Autoradiographic detection of hybridization can then be performed by exposing hybridized filters to photographic film. Densitometric scanning of the photographic films exposed by the hybridized filters provides an accurate measurement of miRNA molecule levels. Using another approach, miRNA molecule levels can be quantified by computerized imaging systems, such the Molecular Dynamics 400-B 2D Phosphorimager available from Amersham Biosciences, Piscataway, N.J.

Where radionuclide labeling of DNA or RNA probes is not practical, the random-primer method can be used to incorporate an analogue, for example, the dTTP analogue 5-(N—(N-biotinyl-epsilon-aminocaproyl)-3-aminoallyl)deoxyuridine triphosphate, into the probe molecule. The biotinylated probe oligonucleotide can be detected by reaction with biotin-binding proteins, such as avidin, streptavidin, and antibodies (e.g., anti-biotin antibodies) coupled to fluorescent dyes or enzymes that produce color reactions.

In addition to Northern and other RNA blotting hybridization techniques, determining the levels of RNA transcripts can be accomplished using the technique of in situ hybridization. This technique requires fewer cells than the Northern blotting technique, and involves depositing whole cells onto a microscope cover slip and probing the nucleic acid content of the cell with a solution containing radioactive or otherwise labeled nucleic acid (e.g., cDNA or RNA) probes. This technique is well-suited for analyzing tissue biopsy samples from subjects. The practice of the in situ hybridization technique is described in more detail in U.S. Pat. No. 5,427,916, the entire disclosure of which is incorporated herein by reference. Suitable probes for in situ hybridization of a given miRNA molecule can be produced from the nucleic acid sequences provided in Table 1, as described above.

The relative number of miRNA transcripts in cells can also be determined by reverse transcription of miRNA transcripts, followed by amplification of the reverse-transcribed transcripts by polymerase chain reaction (RT-PCR). The levels of miRNA gene transcripts can be quantified in comparison with an internal standard, for example, the level of mRNA from a housekeeping gene present in the same sample, such as myosin or glyceraldehyde-3-phosphate dehydrogenase (G3PDH). The methods for quantitative RT-PCR and variations thereof are within the skill in the art.

It is desirable to simultaneously determine the expression level of a plurality of different of miRNA molecules in a sample, for example determine the expression level of the transcripts of known miRNAs correlated with cancer or other cell division disorders (for example, a hematopoietic cell division disorder, such as a B cell lymphoma). Since examining cancer-specific expression levels for hundreds of miRNA molecules is time consuming, requires a large amount of total RNA (at least 20 μg for each Northern blot) and utilizes autoradiographic techniques that require radioactive isotopes, an oligolibrary in microchip format can be constructed containing a set of probe oligonucleotides specific for a set of miRNA molecules (for example, miRNA molecules having any one nucleic acid sequence of SEQ ID NOS: 1-401, shown in Table 1, or any one miRNA molecule of Table 7, Table 9, or Table 10).

A nucleic acid microchip array is a plurality of probe elements, each probe element comprising one or more nucleic acid molecules immobilized on one or more solid surfaces to which sample nucleic acids can be hybridized. Microarrays are known in the art and comprise a surface to which probes that correspond in sequence to gene products (e.g., cDNAs, mRNAs, cRNAs, polypeptides, and fragments thereof), can be specifically hybridized or bound at a known position. The microarray can be an array (i.e., a matrix) in which each position represents a discrete binding site for an RNA, and in which binding sites are present for products of most of the genes in the organism's genome, or a specific tissue or cellular subset of the organism. Here, the binding site can be a nucleic acid or nucleic acid analogue to which a cognate cDNA or RNA, such as miRNA molecule of the invention, can specifically hybridize. The nucleic acid or analogue of the binding site can be, e.g., a synthetic miRNA oligomer.

The nucleic acid or analogue is attached to a solid support, which can be made from glass, plastic (e.g., polypropylene, nylon), polyacrylamide, nitrocellulose, or other materials. A useful method for attaching the nucleic acids to a surface is by printing on glass plates, as is described generally by Schena et al., 1995. See also DeRisi et al., 1996; Shalon et al., 1996; Schena et al., 1996. Each of these articles is incorporated by reference in its entirety.

The microchip is prepared from gene-specific oligonucleotide probes generated from known miRNAs. A nucleic acid array can contain two different oligonucleotide probes for each miRNA, one containing the active sequence and the other being specific for the precursor of the miRNA (for example, see Table 1). The array can also contain controls such as one or more mouse sequences differing from human orthologs by only a few bases, which can serve as controls for hybridization stringency conditions. tRNAs from both species can also be printed on the microchip, providing an internal, relatively stable positive control for specific hybridization. One or more appropriate controls for non-specific hybridization can also be included on the microchip. For this purpose, sequences are selected based upon the absence of any homology with any known miRNAs. For example, the array can also contain miRNA sequences found to be specific for human B cells. Non-limiting examples of such miRNA's include: mir-15, mir-17, mir-14, mir-124a-3, mir-99b, mir-167a, mir-167b, mir-129-1, mir-30c-2, mir-143, mir-27b, mir-125b-1, mir-128a, mir-140, mir-142, mir-191, mir-125b-2, mir-127, mir-129-2, mir-146a, mir-154, mir-185, mir-186, mir-322, mir-124a-1, mir-124a-2, mir-30c-1, mir-302a, and mir-99b.

The microchip can be fabricated by techniques known in the art. For example, probe oligonucleotides of an appropriate length, e.g., 40 nucleotides, are 5'-amine modified at position C6 and printed using commercially available microarray systems, e.g., the GeneMachine OmniGrid™ 100 Microarrayer and Amersham CodeLink™ activated slides. Labeled cDNA oligomer corresponding to the target RNAs is prepared by reverse transcribing the target RNA with labeled primer. Following first strand synthesis, the RNA/DNA hybrids are denatured to degrade the RNA templates. The labeled target cDNAs thus prepared are then hybridized to the microarray chip under hybridizing conditions, e.g. 6.times.SSPE/30% formamide at 25° C. for 18 hours, followed by washing in 0.75.times.TNT at 37° C. for 40 minutes. At positions on the array where the immobilized probe DNA recognizes a complementary target cDNA in the sample, hybridization occurs. The labeled target cDNA marks the exact position on the array where binding occurs, allowing automatic detection and quantification. The output consists of a list of hybridization events, indicating the relative abundance of specific cDNA sequences, and therefore the relative abundance of the corresponding complementary miRs, in the patient sample. According to one embodiment, the labeled cDNA oligomer is a biotin-labeled cDNA, prepared from a biotin-labeled primer. The microarray is then processed by direct detection of the biotin-containing transcripts using, e.g., Streptavidin-Alexa647 conjugate, and scanned utilizing conventional scanning methods. Images intensities of each spot on the array are proportional to the abundance of the corresponding miR in the patient sample.

Other methods for making microarrays (see U.S. Patent Application Publication No. 2006/0051771, which is incorporate by reference in its entirety), e.g., by masking (Fodor et al., 1991; Maskos and Southern, 1992), can also be used. In principal, any type of array, for example, dot blots on a nylon hybridization membrane (see Sambrook et al., 1989, which is incorporated in its entirety for all purposes), can be used, although, as will be recognized by those of skill in the art, very small arrays are useful because hybridization volumes will be smaller.

Labeled cDNA can be prepared from mRNA by oligo dT-primed or random-primed reverse transcription, both of which are well known in the art. Reverse transcription can be carried out in the presence of a dNTP conjugated to a detectable label, for example, a fluorescently labeled dNTP. Alternatively, isolated mRNA can be converted to labeled antisense RNA synthesized by in vitro transcription of double-stranded cDNA in the presence of labeled dNTPs (Lockhart et al., 1996, which is incorporated by reference in its entirety for all purposes). In alternative embodiments, the cDNA or aRNA probe can be synthesized in the absence of detectable label and can be labeled subsequently, e.g., by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, cDNA or aRNA can be labeled indirectly by incorporation of 5-(3-aminoallyl) dNTPs or rNTPs to provide a amine reactive group for subsequent addition of label with any moiety bearing an N-Hydroxysuccinimide (NHS) ester.

Fluorescently labeled probes can be used, including suitable fluorophores such as fluorescein, lissamine, phycoerythrin, rhodamine (Perkin Elmer Cetus), Cy2, Cy3, Cy3.5, Cy5, Cy5.5, Cy7, Fluor X (Amersham) and others (see, e.g., Kricka, 1992, Nonisotopic DNA Probe Techniques, Academic Press San Diego, Calif.). It will be appreciated that pairs of fluorophores are chosen that have distinct emission spectra so that they can be easily distinguished. In another embodiment, a label other than a fluorescent label is used. For example, a radioactive label, or a pair of radioactive labels with distinct emission spectra, can be used (see Zhao et al., 1995; Pietu et al., 1996).

The analysis of microarray data can be accomplished using methods of statistical analysis known to those skilled in the art. For example, clustering analysis is commonly used for interpretation of microarray data. It provides both a visual representation of complex data and a method for measuring similarity between experiments. Some widely used methods for clustering microarray data include: hierarchical, K-means, and self-organizing map.

Southern blot hybridization techniques are also within the skill in the art. For example, genomic DNA isolated from a subject's sample can be digested with restriction endonucleases. This digestion generates restriction fragments of the genomic DNA that can be separated by electrophoresis, for example, on an agarose gel. The restriction fragments are then blotted onto a hybridization membrane (e.g., nitrocellulose or nylon), and hybridized with labeled probes specific for a given miRNA molecule(s). A deletion or mutation of these genes is indicated by an alteration of the restriction fragment patterns on the hybridization membrane, as compared to DNA from a control sample that has been treated identically to the DNA from the subject's sample. Probe labeling and hybridization conditions suitable for detecting alterations in gene structure or sequence can be readily determined by one of ordinary skill in the art. The miRNA nucleic acid probes for Southern blot hybridization can be designed based upon the nucleic acid sequences having SEQ ID NOS: 1-401, provided in Table 1, or any one miRNA molecule of Table 7, Table 9, or Table 10. Nucleic acid probe hybridization can then be detected by exposing hybridized filters to photographic film, or by employing computerized imaging systems, such the Molecular Dynamics 400-B 2D Phosphorimager available from Amersham Biosciences, Piscataway, N.J.

Human miRNAs are associated with different classes of chromosomal features that are subsequently associated with cancer (Xu and Li (2007) Chin Med J (Engl). 120(11):996-9; Bandres et al., (2007) DNA Cell Biol. 26(5):273-82). These cancers are purportedly partly caused by perturbing the chromosome or genomic DNA caused by the cancer-associated chromosomal feature, which can affect expression of oncogenes or tumor-suppressor genes located near the site of perturbation. A given cancer can be treated by restoring the level of miRNA expression associated with that cancer to normal. For example, if the level of miRNA expression is down-regulated in cancer cells of a subject, then the cancer can be treated by increasing the miRNA expression level. Alternatively, if the miRNA expression level is up-regulated in cancer cells of a subject, then the cancer can be treated by decreasing the miRNA expression level.

For example, the level of a miRNA in a cancerous or neoplastic cell of a subject (for example a hematopoietic malignancy or a hematopoietic neoplasm) is first determined relative to control cells. Techniques suitable for determining the relative level of a miRNA molecule in cells have been described above. If miRNA expression is down-regulated in the cancer or neoplastic cell relative to control cells, then the cancer or neoplastic cells are treated with an effective amount of a composition comprising a isolated miRNA molecule which is down-regulated (for example, a miRNA of the invention comprising any one of SEQ ID NOS: 1-401, as shown in Table 1, or any one miRNA molecule of Table 7, Table 9, or Table 10). If miRNA expression is up-regulated in cancer or neoplastic cells relative to control cells, then the cancer or neoplastic cells are treated with an effective amount of a composition that inhibits miRNA expression (for example, a miRNA of the invention comprising any one of SEQ ID NOS: 1-401, as shown in Table 1, or any one miRNA molecule of Table 7, Table 9, or Table 10).

One skilled in the art can also readily determine an appropriate dosage for the administration of an isolated miRNA molecule to a given subject. For example, a miRNA molecule can be administered to the subject once (e.g., as a single injection or deposition). Alternatively, a miRNA molecule of the invention can be administered once or twice daily to a subject for a period of from about two to about twenty-eight days, for example, from about seven to about ten days. Furthermore, the miRNA molecule of the invention can be co-administrated with another therapeutic, such as a chemotherapy drug. Where a dosage regimen comprises multiple administrations, the effective amount of the miRNA molecule administered to the subject can comprise the total amount of gene product administered over the entire dosage regimen.

The miRNA molecules of the invention comprising any one of SEQ ID NOS: 1-401, as shown in Table 1, or any one miRNA molecule of Table 7, Table 9, or Table 10, can be administered to a subject by any means suitable for delivering the miRNA molecules to cells of the subject, such as hematopoietic cells (either cancerous or neoplastic). For example, miRNA molecules can be administered by methods suitable to transfect cells (such as of the subject with the miRNA molecules of the invention. Transfection methods for eukaryotic cells (such as hematopoietic malignant cells or a hematopoietic neoplastic cells) are well known in the art, and include direct injection of the nucleic acid into the nucleus or pronucleus of a cell; electroporation; liposome transfer or transfer mediated by lipophilic materials; receptor mediated nucleic acid delivery, bioballistic or particle acceleration; calcium phosphate precipitation, and transfection mediated by viral vectors.

The compositions of this invention can be formulated and administered to inhibit a variety of disease states by any means that produces contact of the active ingredient with the agent's site of action in the body of a mammal. They can be administered by any conventional means available for use in conjunction with pharmaceuticals, either as individual therapeutic active ingredients or in a combination of therapeutic active ingredients. They can be administered alone, but are generally administered with a pharmaceutical carrier selected on the basis of the chosen route of administration and standard pharmaceutical practice.

Pharmaceutical compositions for use in accordance with the invention can be formulated in conventional manner using one or more physiologically acceptable carriers or excipients. The therapeutic compositions of the invention can be formulated for a variety of routes of administration, including systemic and topical or localized administration. Techniques and formulations generally can be found in *Remmington's Pharmaceutical Sciences*, Meade Publishing Co., Easton, Pa. (1985), the entire disclosure of which is herein incorporated by reference. For systemic administration, injection is useful, including intramuscular, intravenous, intraperitoneal, and subcutaneous. For injection, the therapeutic compositions of the invention can be formulated in liquid solutions, for example, in physiologically compatible buffers such as Hank's solution or Ringer's solution. In addition, the therapeutic compositions can be formulated in solid form and redissolved or suspended immediately prior to use. Lyophilized forms are also included. Pharmaceutical compositions of the present invention are characterized as being at least sterile and pyrogen-free. These pharmaceutical formulations include formulations for human and veterinary use.

The present pharmaceutical formulations comprise the miRNA molecules of the invention comprising any one of SEQ ID NOS: 1-401, as shown in Table 1, or any one miRNA molecule of Table 7, Table 9, or Table 10 (e.g., 0.1 to 90% by weight), or a physiologically acceptable salt thereof, mixed with a pharmaceutically-acceptable carrier. The pharmaceutical formulations of the invention can also comprise the miRNA molecules of the invention comprising any one of SEQ ID NOS: 1-401, as shown in Table 1, or any one miRNA molecule of Table 7, Table 9, or Table 10, which are encapsulated by liposomes and a pharmaceutically-acceptable carrier. Useful pharmaceutically-acceptable carriers are water, buffered water, normal saline, 0.4% saline, 0.3% glycine, hyaluronic acid, and the like.

Pharmaceutical compositions of the invention can also comprise conventional pharmaceutical excipients and/or additives. Suitable pharmaceutical excipients include stabilizers, antioxidants, osmolality adjusting agents, buffers, and pH adjusting agents. Suitable additives include physiologically biocompatible buffers (e.g., tromethamine hydrochloride), additions of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). Pharmaceutical compositions of the invention can be packaged for use in liquid form, or can be lyophilized.

For solid pharmaceutical compositions of the invention, conventional nontoxic solid pharmaceutically-acceptable carriers can be used; for example, pharmaceutical grades of mannitol, lactose, starch, magnesium stearate, sodium saccharin, talcum, cellulose, glucose, sucrose, magnesium carbonate, and the like.

For oral administration, the therapeutic compositions can take the form of, for example, tablets or capsules prepared by conventional means with pharmaceutically acceptable excipients such as binding agents (e.g., pregelatinised maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., ationd oil, oily esters, ethyl alcohol or fractionated vegetable oils); and preservatives (e.g., methyl or propyl-p-hydroxybenzoates or sorbic acid). The preparations can also contain buffer salts, flavoring, coloring and sweetening agents as appropriate.

Preparations for oral administration can be suitably formulated to give controlled release of the active agent. For buccal administration the therapeutic compositions can take the form of tablets or lozenges formulated in a conventional manner. For administration by inhalation, the compositions for use according to the present invention are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol the dosage unit can be determined by providing a valve to deliver a metered amount. Capsules and cartridges of e.g., gelatin for use in an inhaler or insufflate or can be formulated containing a powder mix of the therapeutic agents and a suitable powder base such as lactose or starch.

The therapeutic compositions can be formulated for parenteral administration by injection, e.g., by bolus injection or continuous infusion. Formulations for injection can be presented in unit dosage form, e.g., in ampoules or in multi-dose containers, with an added preservative. The compositions can take such forms as suspensions, solutions or emulsions in oily or aqueous vehicles, and can contain formulatory agents such as suspending, stabilizing and/or dispersing agents. Alternatively, the active ingredient can be in powder form for constitution with a suitable vehicle, e.g., sterile pyrogen-free water, before use.

Suitable enteral administration routes for the present methods include oral, rectal, or intranasal delivery. Suitable parenteral administration routes include intravascular administration (e.g. intravenous bolus injection, intravenous infusion, intra-arterial bolus injection, intra-arterial infusion and catheter instillation into the vasculature); peri- and intra-tissue injection (e.g., peri-tumoral and intra-tumoral injection, intra-retinal injection, or subretinal injection); subcutaneous injection or deposition including subcutaneous infusion (such as by osmotic pumps); direct application to the tissue of interest, for example by a catheter or other placement device (e.g., a retinal pellet or a suppository or an implant comprising a porous, non-porous, or gelatinous material); and inhalation. The miRNA molecules of the invention are administered by injection or infusion.

In addition to the formulations described previously, the therapeutic compositions can also be formulated as a depot preparation. Such long acting formulations can be administered by implantation (for example subcutaneously or intramuscularly) or by intramuscular injection. Thus, for example, the therapeutic compositions can be formulated with suitable polymeric or hydrophobic materials (for example as an emulsion in an acceptable oil) or ion exchange resins, or as sparingly soluble derivatives, for example, as a sparingly soluble salt.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration bile salts and fusidic acid derivatives. In addition, detergents can be used to facilitate permeation. Transmucosal administration can be through nasal sprays or using suppositories. For topical administration, the compositions of the invention are formulated into ointments, salves, gels, or creams as generally known in the art. A wash solution can be used locally to treat an injury or inflammation to accelerate healing. For oral administration, the therapeutic compositions are formulated into conventional oral administration forms such as capsules, tablets, and tonics.

A composition of the present invention can also be formulated as a sustained and/or timed release formulation. Such sustained and/or timed release formulations can be made by sustained release means or delivery devices that are well known to those of ordinary skill in the art, such as those described in U.S. Pat. Nos. 3,845,770; 3,916,899; 3,536,809; 3,598,123; 4,008,719; 4,710,384; 5,674,533; 5,059,595; 5,591,767; 5,120,548; 5,073,543; 5,639,476; 5,354,556; and 5,733,566, the disclosures of which are each incorporated herein by reference. The pharmaceutical compositions of the present invention can be used to provide slow or sustained release of one or more of the active ingredients using, for example, hydropropylmethyl cellulose, other polymer matrices, gels, permeable membranes, osmotic systems, multilayer coatings, microparticles, liposomes, microspheres, or the like, or a combination thereof to provide the desired release profile in varying proportions. Suitable sustained release formulations known to those of ordinary skill in the art, including those described herein, can be readily selected for use with the pharmaceutical compositions of the invention. Thus, single unit dosage forms suitable for oral administration, such as, but not limited to, tablets, capsules, gelcaps, caplets, powders, and the like, that are adapted for sustained release are encompassed by the present invention.

In the present methods, the miRNA molecules of the current invention comprising any one of SEQ ID NOS: 1-401, as shown in Table 1, or any one miRNA molecule of Table 7, Table 9, or Table 10, can be administered to the subject either as naked RNA, in conjunction with a delivery reagent, or as a nucleic acid (e.g., a recombinant plasmid or viral vector) comprising sequences which expresses the gene product. Suitable delivery reagents for administration of the miRNA molecules include the Mims Transit TKO lipophilic reagent; lipofectin; lipofectamine; cellfectin; or polycations (e.g., polylysine), or liposomes.

The dosage administered will be a therapeutically effective amount of the composition sufficient to result in amelioration of symptoms of B cell lymphoma disease and can vary depending upon known factors such as the pharmacodynamic characteristics of the particular active ingredient and its mode and route of administration; age, sex, health and weight of the recipient; nature and extent of symptoms; kind of concurrent treatment, frequency of treatment and the effect desired.

Toxicity and therapeutic efficacy of therapeutic compositions of the present invention can be determined by standard pharmaceutical procedures in cell cultures or experimental animals, e.g., for determining the LD50 (The Dose Lethal To 50% Of The Population) and the ED50 (the dose therapeutically effective in 50% of the population). The dose ratio between toxic and therapeutic effects is the therapeutic index and it can be expressed as the ratio LD50/ED50. Therapeutic agents which exhibit large therapeutic indices are useful. Therapeutic compositions that exhibit some toxic side effects can be used.

Appropriate doses of small molecule agents depends upon a number of factors known to those or ordinary skill in the art, e.g., a physician. The dose(s) of the small molecule will vary, for example, depending upon the identity, size, and condition of the subject or sample being treated, further depending upon the route by which the composition is to be administered, if applicable, and the effect which the practitioner desires the small molecule to have upon the nucleic acid or polypeptide of the invention. Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram.

These methods described herein are by no means all-inclusive, and further methods to suit the specific application will be apparent to the ordinary skilled artisan. Moreover, the effective amount of the compositions can be further approximated through analogy to compounds known to exert the desired effect.

The practice of aspects of the present invention can employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press:

1989); DNA Cloning, Volumes I and II (D. N. Glover ed., 1985); Oligonucleotide Synthesis (M. J. Gait ed., 1984); Mullis et al. U.S. Pat. No. 4,683,195; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Manipulating the Mouse Embryo, (Cold Spring Harbor Laboratory Press, Cold Spring Harbor, N.Y., 1986). All patents, patent applications and references cited herein are incorporated in their entirety by reference.

EXAMPLES

A number of Examples are provided below to facilitate a more complete understanding of the present invention. The following examples illustrate the exemplary modes of making and practicing the present invention. However, the scope of the invention is not limited to specific embodiments disclosed in these Examples, which are for purposes of illustration only, since alternative methods can be utilized to obtain similar results.

Example 1

Experimental Analysis:
We have used an established process for the identification of miRNAs candidates by sequencing size-fractionated cDNA libraries from three normal B cell populations, including Naïve B cells, Centroblasts and Memory B cells and from a Burkitt Lymphoma cell line (Ramos). Briefly, short RNAs (sRNA) extracted from the cells were linked to adaptor oligonucleotides, reverse transcribed, PCR amplified, cloned into an expression vector, and sequenced. Individual sequences, corresponding to short RNAs, were then analyzed bioinformatically to determine whether they would constitute appropriate miRNA candidates.

Bioinformatics Analysis:
The computational analysis starts with the identification of short RNA (sRNA) sequences from cloned cDNA sequences using the adaptor oligonucleotides as oriented markers. Then, each sRNA was matched to the human genome (ncbi36, October 2006) by using Megablast (NCBI).

A Bayesian evidence integration scheme was used to identify candidate sRNAs from partial matches to the human genome. Single and multiple base mismatches can occur for several reasons, including polymorphysms, sequencing errors, PCR errors that are more frequent in the 3' and 5' region of the miRNA cDNA, and RNA editing enzymes.

To identify sequences that correspond to real sRNAs, we used the following Bayesian approach to compute the posterior probability that a sequence is a candidate miRNA genomic match given specific base pair substitutions under the assumption that individual mutations are uncorrelated (Naïve Bayes). The individual $p(m_i|\text{match})$ and $p(m_i)$ can be measured using matches to the miRNAs deposited in the miRNABase database. Sequences with p (match|$m_1$, $m_2$, ..., $m_n$)>0.5 were considered bona-fide matches to the human genome sequences and further processed together with the exact matching ones. $m_1, m_2, \ldots, m_n$:

$$p(\text{match}|m_1, m_2, \ldots, m_n) = p(m_1, m_2, \ldots, m_n|\text{match})$$

$$\frac{p(\text{match})}{p(m_1, m_2, \ldots, m_n)}$$

$$= p(\text{match}) \prod \frac{p(m_i|\text{match})}{p(m_i)}$$

Resulting sRNA genome locations, both for exact and partial matches, were analyzed and merged, if necessary, to remove overlapping sequences. For each sRNA hit a sequence from −80 bp upstream to +80 b.p. downstream of the sRNA match was selected leading to a set of candidate microRNA genes, including the full length precursors.

These longer sequences were then analyzed to determine if they can lead to the formation of precursor miRNA structures, including favorable energetics to for the established stem-loop secondary RNA structure required for further miRNA processing. Using a set of established mammalian miRNA's and data from the scientific literature the following criteria were established:

1. Mature sequence, which is defined by matching sRNA's, should occupy only one arm of hairpin (not the loop).
2. Loop structure can not be shorter that 3 b.p. or longer than 20 b.p.
3. Hairpin stem should not host additional secondary RNA structures with more that 10 b.p.
4. The ratio between the number of complementary base pairs and the total number of base pairs comprising hairpin arms should be bigger that 0.55.
5. Free energy should not be bigger then −20 kcal/mole.

We do not apply highly popular conservation criteria because of:
significant incompleteness of many genome assemblies especially in intergenic regions
Risk to lose unique or diverged miRNA's (this invention is directed to obtaining an exhaustive search and outcome)
Possibility of further experimental verification of candidates.

Since the exact sites of transcription initiation and termination for miRNA genes is not known and since concentration and temperature can vary, it is important to consider not just the optimal folding variant but an entire distribution of variants near the optimal one. We used the Vienna RNA package to perform this type of analysis, with appropriate modifications to allow the analysis of suboptimal folding variants.

Candidate miRNA genes were filtered against non-coding RNA database and repeats database (repbase). Database of human non-coding RNA's is manually compiled and contains genes like ribosomal RNA's, snRNA, tRNA's, Y-RNA and others. Comparison performed using MEGABLAST program (NCBI).

Figure 2:
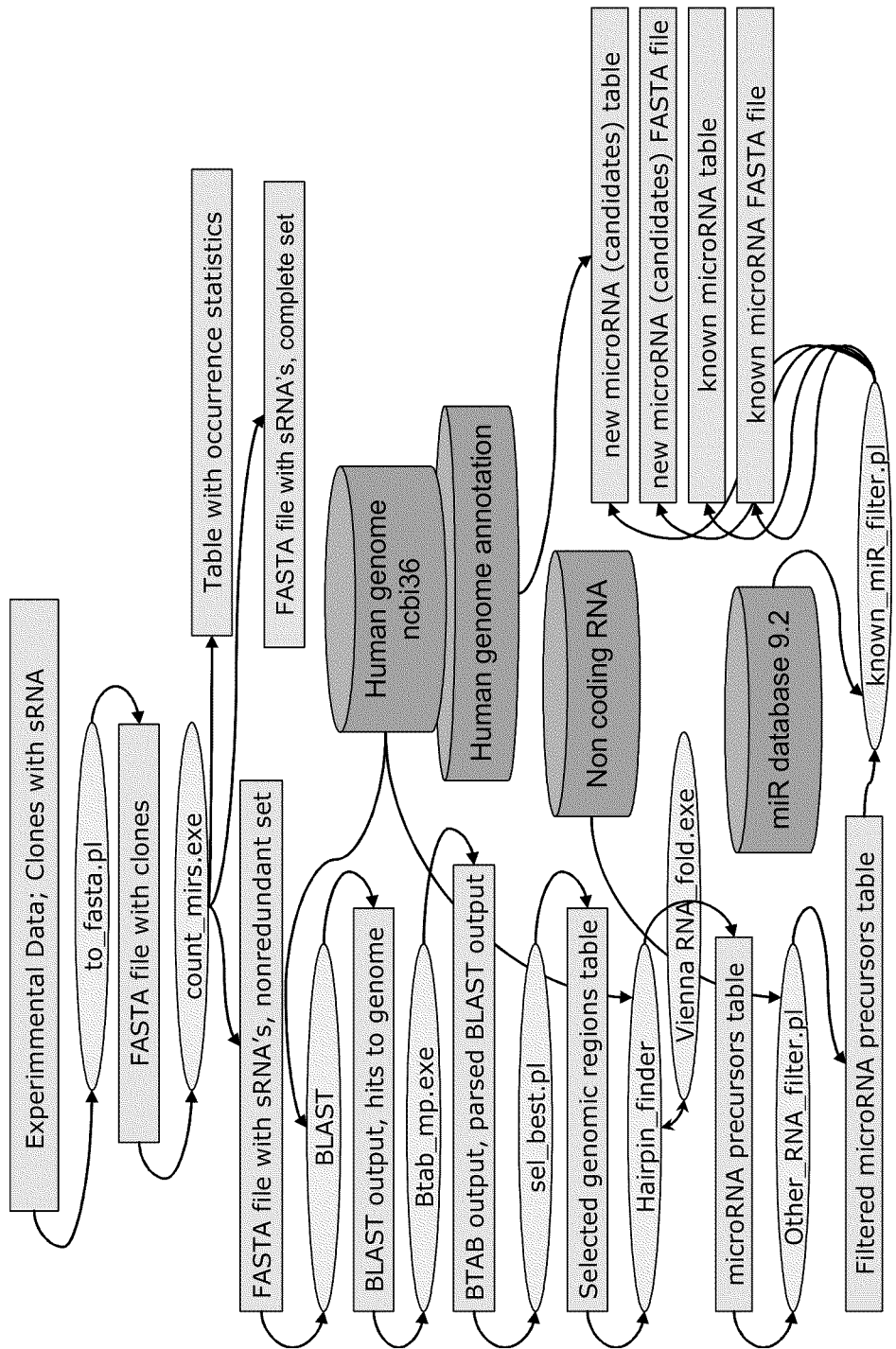
FIG. 2 is a flow diagram of a computational pipeline.
Figure 3:
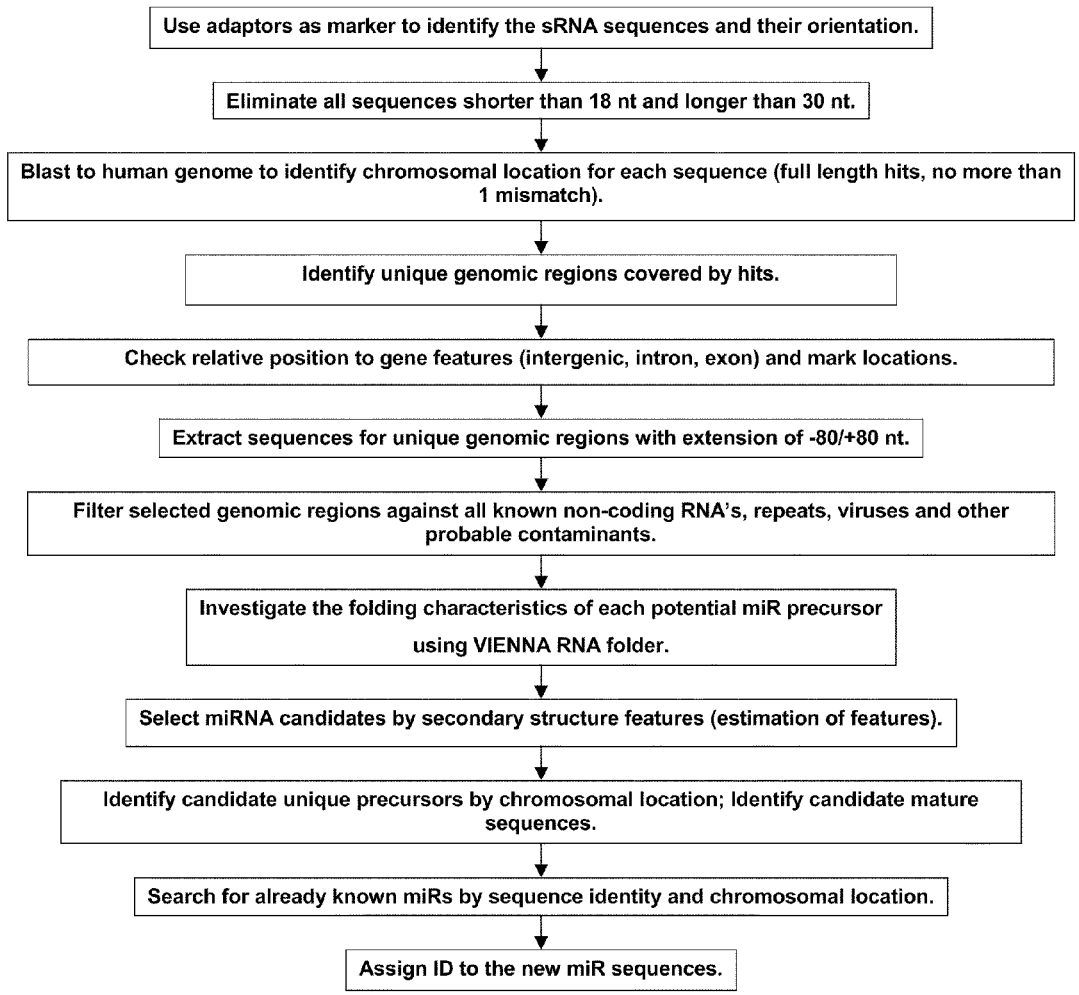
FIG. 3 is a flow diagram of a computational pipeline.
Figure 4:
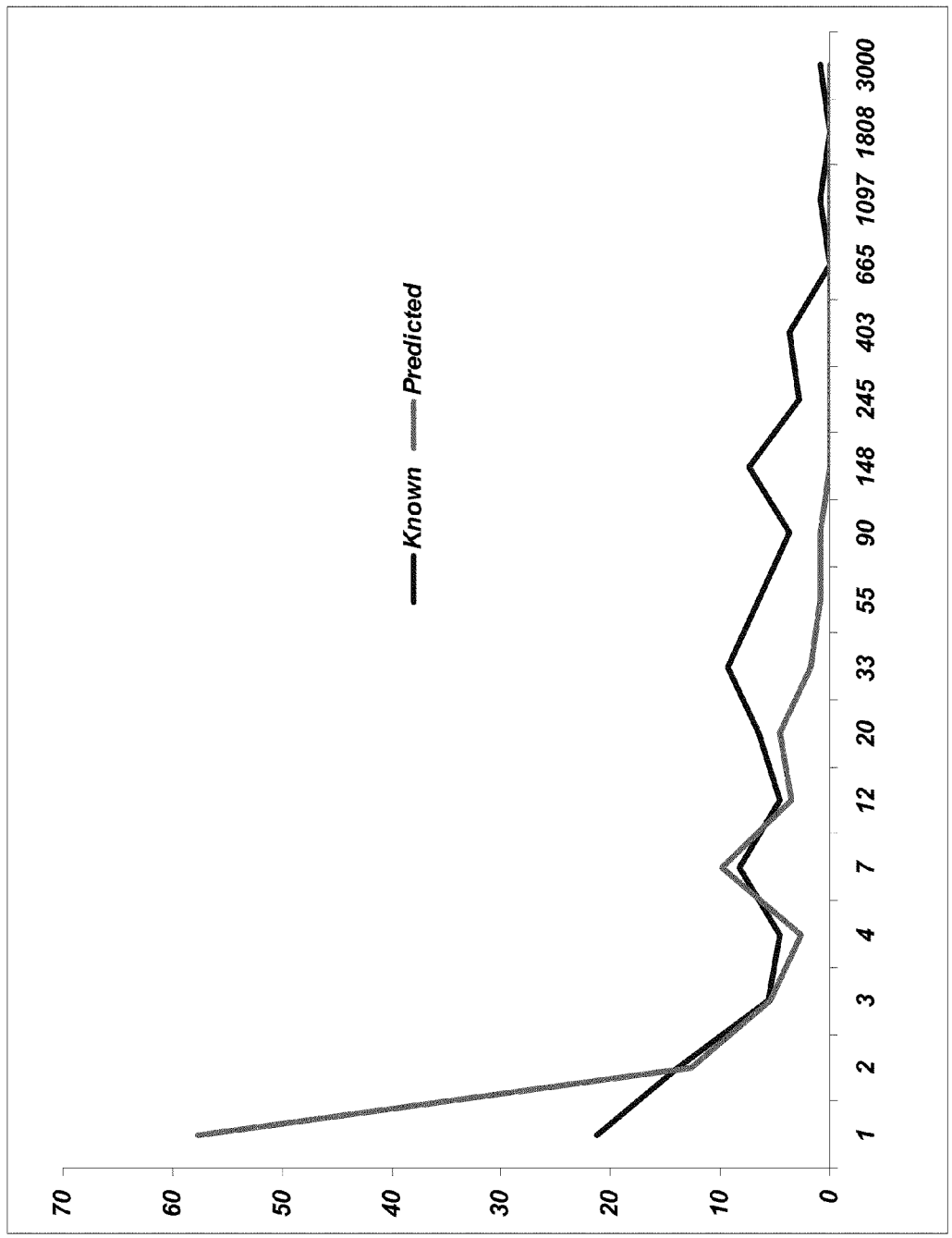
FIG. 4 is a graph depicting frequency distributions.
Figure 5:
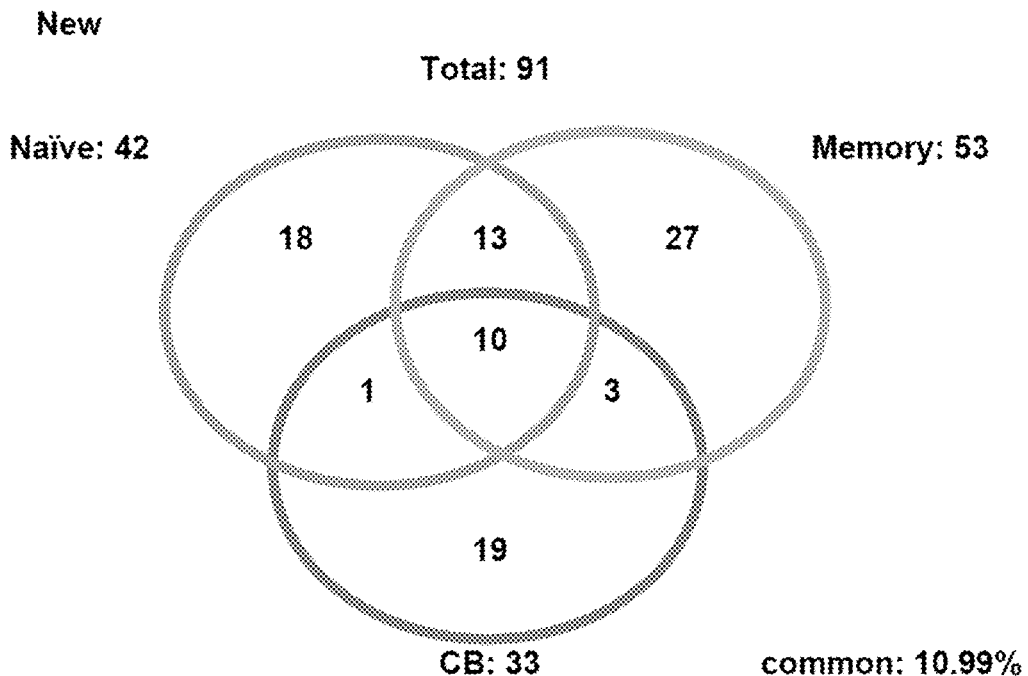
FIG. 5 is a diagram for new miRNAs identified in CB, Memory, and Naïve cells.
Figure 6:
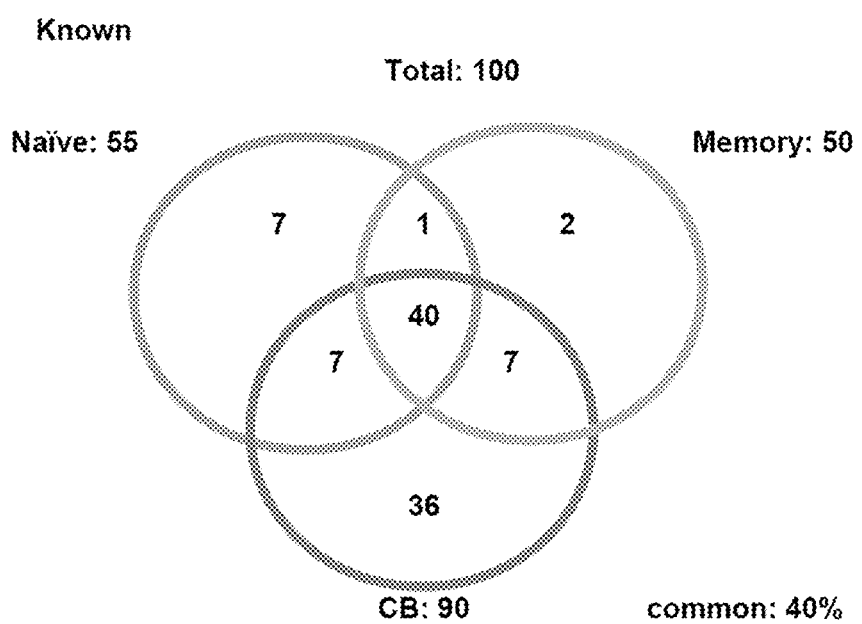
FIG. 6 is a diagram for known miRNAs identified in CB, Memory, and Naïve cells.
Figure 7:
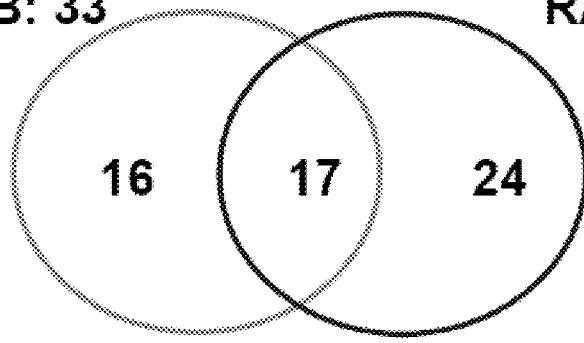
FIG. 7 is a diagram for new miRNAs identified in CB and RA cells.
Figure 8:
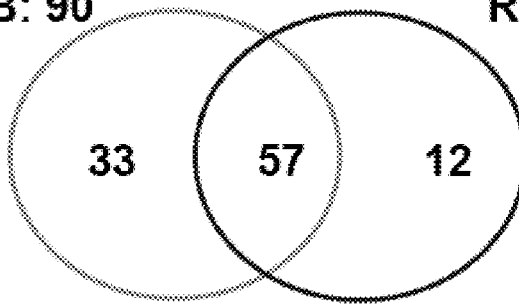
FIG. 8 is a diagram for known miRNAs identified in CB and RA cells
Figure 9:
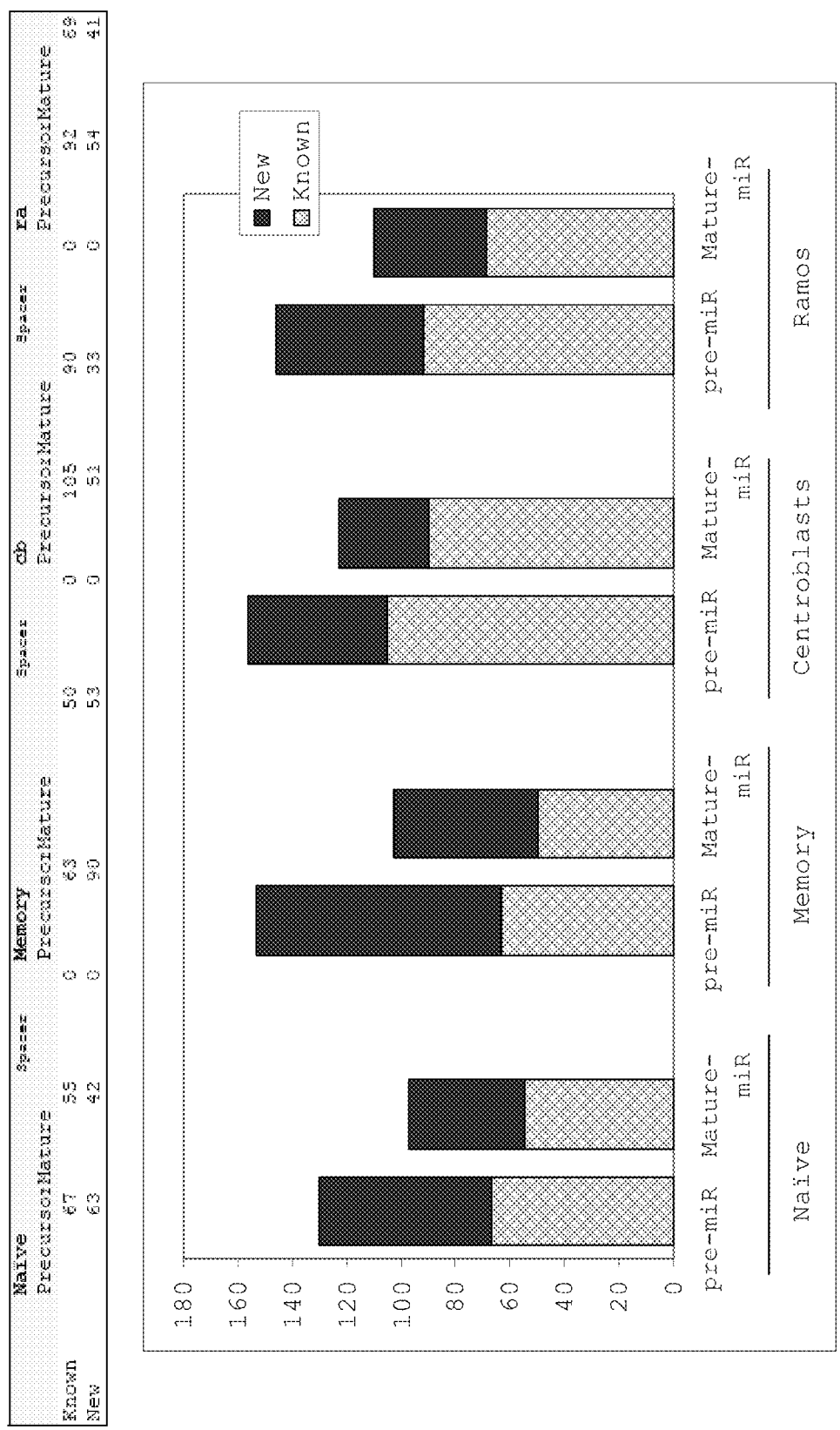
FIG. 9 is a bar graph depicting computational predictions of precursors from cloned mature miRNA.

Finally, candidate miRNAs emerging from this analysis were compared to miRNABase database to identify previously known miRNAs. Candidate miRNAs that were not identified in the miRNABase were considered. Diagrams illustrating these steps are included as FIGS. 1-3.

Validation:
Some of the newly identified miRNAs were tested by Northern in the corresponding population in which the sRNA was isolated.

Newly Identified miRNAs

The following have been identified as newly identified miRNAs (miRNAs) in one or more of the four B cell populations from which the size-fractionated cDNA libraries were isolated.

Example 2

Protocol for microRNA Cloning

Preparation and Labeling of Decade Marker (Ambion #7778)

Decade marker is radio labeled using [γ-$^{32}$P]ATP according to the manufacturer instructions.

Labeling of the RNA Carrier 20 pmol of #909 carrier RNA oligo is radio labeled using [γ-$^{32}$P]ATP and T4 Polynucleotide kinase (NEB).

Purification of 18-26mers from Total RNA

A 15% denaturing polyacrylamide gel was prepared using the Sequagel System (National Diagnostics) following the manufacturer instructions. A metal plate was placed on the front of the gel and was pre-run at 50 W for 30 minutes using a running buffer of 0.5×TBE. Each RNA sample [long of total RNA] was subsequently spiked 1 pmol (2.5 nl) of [γ-$^{32}$P] labeled-#909 carrier and an equal volume of 2×RNA loading buffer (Ambion) was added. For total RNA, extraction procedures like Trizol Reagent (Invitrogen) that purify all sizes RNA are recommended. Samples were then boiled for 5 minutes and were loaded with decade marker. After samples were loaded onto the gel, it was run for 3-4 hours at 50 W. After the gel was run, the apparatus was disassemble and one of the glass pieces was removed. The hot area of the gel was cut out and placed on the side of the lane for alignment with the markers. The gel was subsequently covered with a plastic wrap and was exposed to a phosphoimage screen for about 30 minutes to an 1 hour. The gel image was printed at 100% magnification and placed under the glass. It was then aligned with the hot spot that had been previously cut. The RNA band was cut approximately from 18mers up to 26mers using the marker and the 1 nt ladder below the carrier as reference. RNA was eluted from the gel using 2 ml of 0.3M NaCl in DEPC H$_2$O, and the eluted sample was subsequently rotated overnight at 4° C. The supernatant was then recovered and 450 μl (max) was distributed into separate tubes. A 2× volume of 100% EtOH and 10 ng glycogen were added to each tube, which were then incubated at −20° C. for at least 2 hours. Samples were then spun for 30 minutes at 14,000 rpm, and were subsequently washed with 75% EtOH. The pellets were then air dried and dissolved in 10 μl, DEPC H$_2$O.

3'-Adaptor Ligation and Purification

The following were first mixed in a tube and were then incubated at 25° C. for 6 hours:

| | |
|---|---|
| 1.5 μl | 10X 3' Ligation Buffer* |
| 7.5 μl | purified small RNA |
| 2 μl | App.17.91 [100 pmol/μl] (adenylated) |
| 1.5 μl | T4 RNA Ligase [30 U/μl] (Amersham) |
| 2.5 μl | H$_2$O |

*500 mM Tris-HCl (pH 7.5), 100 mM MgCl$_2$, 100 mM DTT, 600 μg/ml BSA. Store at −20° C.

15 μl, of 2× Loading Buffer (Ambion) was added to the samples and boiled for 5 minutes, which were then loaded onto a 12% denaturing polyacrylamide gel thata was prepared using the Sequagel System (National Diagnostics) following the manufacturer instructions. A metal plate was placed on the front of the gel and was pre-run at 50 W for 30 minutes using a running buffer of 0.5×TBE. The decade RNA marker and 1 μl, of [γ-$^{32}$P] labeled-#909 carrier was then loaded into separated lanes and run for 3-4 hours at 50 W. After the gel was run, the apparatus was disassemble and the gel was exposed to a phosphoimage screen for 2-4 hours. The gel image was printed at 100% magnification and placed under the glass. The ligation product ranging approximately from 35 up to 42-45 nt was cut and RNA was eluted from the gel using 2 ml of 0.3M NaCl in DEPC H$_2$O. The eluted sample was subsequently rotated overnight at 4° C. The supernatant was then recovered and 450 μl (max) was distributed into separate tubes. A 2× volume of 100% EtOH and 10 mg glycogen were added to each tube, which were then incubated at −20° C. for at least 2 hours. Samples were then spun for 30 minutes at 14,000 rpm, and were subsequently washed with 75% EtOH. The pellets were then air dried and dissolved in 12 μl DEPC H$_2$O.

5'-Adaptor Ligation and Purification

The following were first mixed in a tube and were then incubated at 25° C. for 6 hours:

| | |
|---|---|
| 1 μl | 10X Ligation Buffer (Amersham) |
| 6 μl | purified small RNA |
| 2 μl | 17.93 oligo [100 pmol/μl] |
| 1 μl | T4 RNA Ligase [30 U/μl] (Amersham) |

Samples can be stored at 4° C. after the 6 hour incubation until further processed. 10 μl of 2× Loading Buffer (Ambion) was added to the samples and boiled for 5 minutes, which were then loaded onto a 10% denaturing polyacrylamide gel thata was prepared using the Sequagel System (National Diagnostics) following the manufacturer instructions. A metal plate was placed on the front of the gel and was pre-run at 50 W for 30 minutes using a running buffer of 0.5×TBE. The decade RNA marker and 1 μl of [γ-32P] labeled-#909 carrier was then loaded into separated lanes and run for 3 hours at 50 W. After the gel was run, the apparatus was disassemble and the gel was exposed to a phosphoimage screen for 12-18 hours. The gel image was printed at 100% magnification and placed under the glass. The ligation product ranging approximately from 35 up to 48-62 nt was cut and RNA was eluted from the gel using 2 ml of 0.3M NaCl in DEPC H$_2$O. The eluted sample was subsequently rotated overnight at 4° C. The supernatant was then recovered and 450 μl (max) was distributed into separate tubes. A 2× volume of 100% EtOH and 10 ng glycogen were added to each tube, which were then incubated at −20° C. for at least 2 hours. Samples were then spun for 30 minutes at 14,000 rpm, and were subsequently washed with 75% EtOH. The pellets were then air dried and dissolved in 20 μl DEPC H$_2$O.

Reverse Transcription

The following were first mixed in a PCR tube and were then incubated at 80° C. for 2 minutes:

| | |
|---|---|
| 10 μl | ligated RNA |
| 3 μl | #918 primer [100 μM] |

The sample was subsequently spun down to cool. Using the First Strand Synthesis System kit (Invitrogen), the following was added to the sample which was then incubated at 48° C. for 2 minutes:

| | |
|---|---|
| 5 µl | 5X First Strand Buffer |
| 7 µl | dNTPs |
| 3 µl | 0.1M DTT |

3 µl of SuperScriptII (Invitrogen) was then added to the sample, which was further incubated at 48° C. for 1 hour. Samples can then be stored at −20° C. until further processing.

PCR Amplification

The PCR reaction was prepared as follows:
5% Reverse Transcription product
1×PCR buffer
1.5 mM MgCl$_2$
0.8 mM dNTP
2 µM #913 primer
2 µM #914 primer
2 U Taq polymerase The sample was then amplified according to the following protocol:

$$\left.\begin{array}{ll} 2' & 94° \text{ C.} \\ 30'' & 94° \text{ C.} \\ 30'' & 52° \text{ C.} \\ 30'' & 72° \text{ C.} \\ 10' & 72° \text{ C.} \end{array}\right\} \times 30 \text{ cycles}$$

The sample was then extracted using Phenol/CIA and was precipitated with sodium acetate. The sample was then spun for 30 minutes at 14,000 rpm, and was subsequently washed with 75% EtOH. The pellet was then air dried and dissolved in 45 DEPC H$_2$O.

PACI Digestion

The digestion was prepared as follows and was subsequently incubate at 37° C. for 90 minutes:
1×NEB Buffer 1
1×BSA
1,000 U/µl PACI
42.5 µl DNA The sample was then extracted using Phenol/CIA and was precipitated with sodium acetate. The sample was then spun for 30 minutes at 14,000 rpm, and was subsequently washed with 75% EtOH. The pellet was then air dried and dissolved in 15 µl DEPC H$_2$O, Non-denaturing Loading Buffer was added to the sample and the sample was subsequently loaded onto a 12% non-denaturing acrylamide gel using pUC19/Sau3AI as a marker (Ambion #7760), which was run at 13 W for approximately 1 hr. The gel was then stained with 1:10, 000 SybrGold (Molecular Probes #S-11494) in 0.5×TBE for 30 to 60 minutes. The smear of digested samples was then cut between 46 and 75 nt according to the marker size. Cut out samples were then eluted with 500 µl of 0.3M NaCl in 1.5 ml screw top tubes, rotating overnight at 4° C. Samples were spun briefly, and about 450 µl of eluted volume was recovered for each sample. The samples were then extracted using Phenol/CIA and were precipitated with sodium acetate. The samples were then spun for 30 minutes at 14,000 rpm, and were subsequently washed with 75% EtOH. The pellet was then air dried and dissolved in 10 µl DEPC H$_2$O. If the amount of digested product on the gel appeared to be low, a second PCR amplification was required.

Second PCR Amplification

The PCR reaction was prepared as follows:
2% Reverse Transcription product
1×PCR buffer
1.5 mM MgCl$_2$
0.8 mM dNTP
2 µM #913 primer
2 µM #914 primer
2 U Taq polymerase The sample was then amplified according to the following protocol:

$$\left.\begin{array}{ll} 2' & 94° \text{ C.} \\ 30'' & 94° \text{ C.} \\ 30'' & 52° \text{ C.} \\ 30'' & 72° \text{ C.} \\ 10' & 72° \text{ C.} \end{array}\right\} \times 20 \text{ cycles}$$

The amount of product generated was examined via adding non-denaturing Loading Buffer to 5 µl of sample, which was then loaded onto a 12% non-denaturing acrylamide gel, and was subsequently run at 13 W for approximately 1 hr. Samples were cut out and eluted with 500 µl of 0.3M NaCl in 1.5 ml screw top tubes, rotating overnight at 4° C. Samples were spun briefly, and about 450 µl of eluted volume was recovered for each sample. The samples were then extracted using Phenol/CIA and were precipitated with sodium acetate. The samples were then spun for 30 minutes at 14,000 rpm, and were subsequently washed with 75% EtOH. The pellet was then air dried and dissolved in 45 DEPC H$_2$O, Samples were further quantified, wherein amount of sampled needed to be within the range of 200-500 ng/µl.

BanI Digestion

The following digestion was prepared for each sample as follows, and were subsequently incubated at 37° C. for 2.5 hours:
1×NEB Buffer 4
1×BSA
1000 U/µl BanI Samples were then extracted using Phenol/CIA and were precipitated with sodium acetate. The samples were spun for 30 minutes at 14,000 rpm, and were subsequently washed with 75% EtOH. The pellet was then air dried and dissolved in 26 µl DEPC H$_2$O.

Concatemerization

The following sample was mixed in a 0.5 or 0.2 ml tube as follows, and was incubated at 25° C. for 2 hours:

| | |
|---|---|
| 26 µl | Digested DNA |
| 3 µl | 10X Ligation Buffer (Roche) |
| 1 µl | T4 DNA Ligase [5 U/µl] (Roche) |

1 µl of dNTP as well as 1 µl of DNA Polymerase I was subsequently added, and the sample was then incubated at 16° C. for 1 hour. The sample was run on a 2% LM agarose-EtBr gel in 0.5×TBE with 100 bp Ladder loaded in the first lane. The concatamers were then cut starting from about 500 bp and above. Samples were then gel purified with QIAquick gel extraction kit (Qiagen cat. #28706), using the manufacturer's instructions.

Vector Digestion

The pCR2.1-TOPO (Invitrogen, 3.9 Kb) vector was digested according to the manufacturer's instructions for the EcoRV enzyme (NEB). The samples was then subjected to gel electrophoresis using a 1% agarose gel. The sample was then gel purified with QIAquick gel extraction kit (Qiagen cat. #28706), using the manufacturer's instructions.

Ligation

The ligation reaction was set up using the Rapid Ligation Kit (Roche cat. #11635379001) according to the procedure recommended by the manufacturer. 10 µl of the ligation product was used for transformation in high efficiency bacteria (One Shot OminMAX—Invitrogen cat. #C8540-03). X-gal/IPTG Ampicillin agarose plates were prepared fresh and a specified volume of the transformation reaction was spread onto the plates. Plated samples were then incubated overnight at 37° C. Colonies were then obtained the next day and grown in 30 µl of LB medium at 37° C. for 1 hour. Once DNA was obtained from the amplified bacteria, 2.5 µl was used as template for the colony PCR reaction.

Colony PCR

The PCR reaction was prepared as follows:

2.5 µl template
1×PCR buffer
1.5 mM MgCl$_2$
0.8 mM dNTP
0.2 µM #913 primer
0.2 µM #914 primer
1 U Taq polymerase The sample was then amplified according to the following protocol:

```
5'   94° C.
30"  94° C.
30"  52° C.  × 30 cycles
30"  72° C.
10'  72° C.
```

1 µl of PCR product was examined on a 1.5% agarose gel and clones were selected carrying an insert longer than 350 bp. Samples were then confirmed by sequencing.

Oligonucleotides

```
909 carrier RNA oligo:
5'-(P)-UGUCAGUUUGUUAAUUAACCCAA-3'   [SEQ ID NO: 517]
```

5' phosphate; 3' none; includes PACI restriction site

```
App. 17.91 (3' end Donor oligo):
5'-rAppCTGTAGGCACCATCAAT/3ddC-3'   [SEQ ID NO: 518]
```

5' adenylated containing a pyrophosphate; 3' modified terminal dideoxy-C(ddC) (available from IDT Inc. as the "miRNA cloning linker"); includes BanI restriction site.

```
17.93 (5' end Acceptor oligo):
5'-ATCGTAGGCACCTGAAA-3'   [SEQ ID NO: 519]
```

It includes BanI restriction site.

```
#918 RT primer oligo:
5'-ATTGATGGTGCCTAC-3'   [SEQ ID NO: 520]
```

It includes BanI restriction site.

```
#913 (5' PCR primer oligo):
5'-ATCGTAGGCACCTGAAA-3'   [SEQ ID NO: 521]
```

It includes BanI restriction site.

```
#914 (3' PCR primer oligo):
5'-ATTGATGGTGCCTACAG-3'   [SEQ ID NO: 522]
```

It includes BanI restriction site.

Screening/Sequencing Primers:

```
M13F 5'-GTAAAACGACGGCCAG-3'   [SEQ ID NO: 523]
M13R 5'-CAGGAAACAGCTATGAC-3'   [SEQ ID NO: 524]
```

REFERENCES

Lau et al., Science (2001) 294:858-62; Chen et al., Science (2004) 303: 83-6

Example 3

Identification of the Human Mature B Cells miRNome

The discovery of microRNAs (miRNAs) has added a new dimension to the mechanisms that regulate gene expression in normal cell development. Initial evidence also shows that structural or functional alterations of miRNAs are associated with tumorigenesis. The full set of microRNAs (miRNAs) in the human genome is not known. Since presently known miRNAs have been identified by virtue of their abundant expression in a few cell types, tissue-specific miRNAs may remain unrevealed. To understand the role of miRNAs in B-cell function and lymphomagenesis, short-RNA libraries were generated from normal human B cells at different stages of development (naïve, germinal-center, memory) and from a Burkitt lymphoma cell-line. The combination of cloning and computational analysis identified 401 miRNA (miRNome) expressed during normal B-cell development and/or in transformed B-cells. Most notably, this analysis identified 272 new miRNAs that were not previously reported. Numerous miRNAs are expressed in a stage-specific as well as transformation-specific fashion, suggesting specific functional roles. These results significantly increase the number of presently known miRNAs and provide a resource for the study of their role in B-cell development, immune function, and lymphomagenesis.

A new level of post-transcriptional regulation has been revealed with the discovery of microRNAs (miRNAs) a class of short-RNAs that impair translation or induce mRNA degradation by binding to the 3' untranslated region of target mRNA[1,2]. The most recent release of the miRBase database (v.11.0)[3,4] reports 839 human miRNAs, but the discovery of miRNAs is still an on-going process with variable predictions about the total number of miRNAs expressed in mammalian cells ranging from one thousand to several thousands[5,6]. The reported miRNAs have been identified from a limited number of cell types or from tissues whose cellular heterogeneity may favor the identification of ubiquitous and abundant miRNA. In fact, a recent report aiming to the identification of the miRNA expression profiles from 26 different mammalian tissues and cell types led to the discovery of only 12 new human miRNA[7]. These findings led to the conclusion that most miRNAs are known and that most of them are ubiquitously expressed. Nonetheless, additional analyses of purified cell populations may lead to the identification of tissue- and stage of differentiation-specific miRNAs, as has been the case for messenger RNAs.

The role of specific miRNAs in B-cell immunity and malignancy has only just begun to be elucidated. Using mouse models, miR-155 has been demonstrated to affect regulation of germinal center response through modulation of cytokine production[8,9]. Recently, miR-150 has been shown to target c-Myb, a critical transcription factor involved in the control of B cell differentiation[10]. In B cell lymphomas, 13q31 amplification has been associated with the over-expression of the miR-17-92 cluster and its enforced expression in a murine B cell lymphoma model showed a role in accelerating tumor development[11]. Furthermore, miR-15a and miR-16 have been implicated in the pathogenesis of B cell chronic lymphocytic leukemia (CLL)[12,13].

To further explore the role of miRNAs in B cell function and lymphomagenesis, this study was aimed at identifying the miRNAs expressed (miRNome) in the human mature B-cell compartment, including naïve, germinal centers (GCs), and memory B cells. These B cell subpopulations are relevant for the development of antibody-mediated immunity as well as for tumorigenesis, since common human B-cell malignancies originate from the malignant transformation of GC B cells (most B-cell non-Hodgkin lymphomas, B-NHL), or naïve and memory B cells (mantle cell lymphoma and chronic lymphocytic leukemia)[14,15]. Using a combination of cloning and computational analysis, we report the identification of 401 miRNA representing the mature B cell miRNome, including 272 new miRNAs, and illustrate their pattern of expression during B cell differentiation and transformation.

Construction of Short-RNA Libraries from Human B Cell Sub Populations

Figure 10:
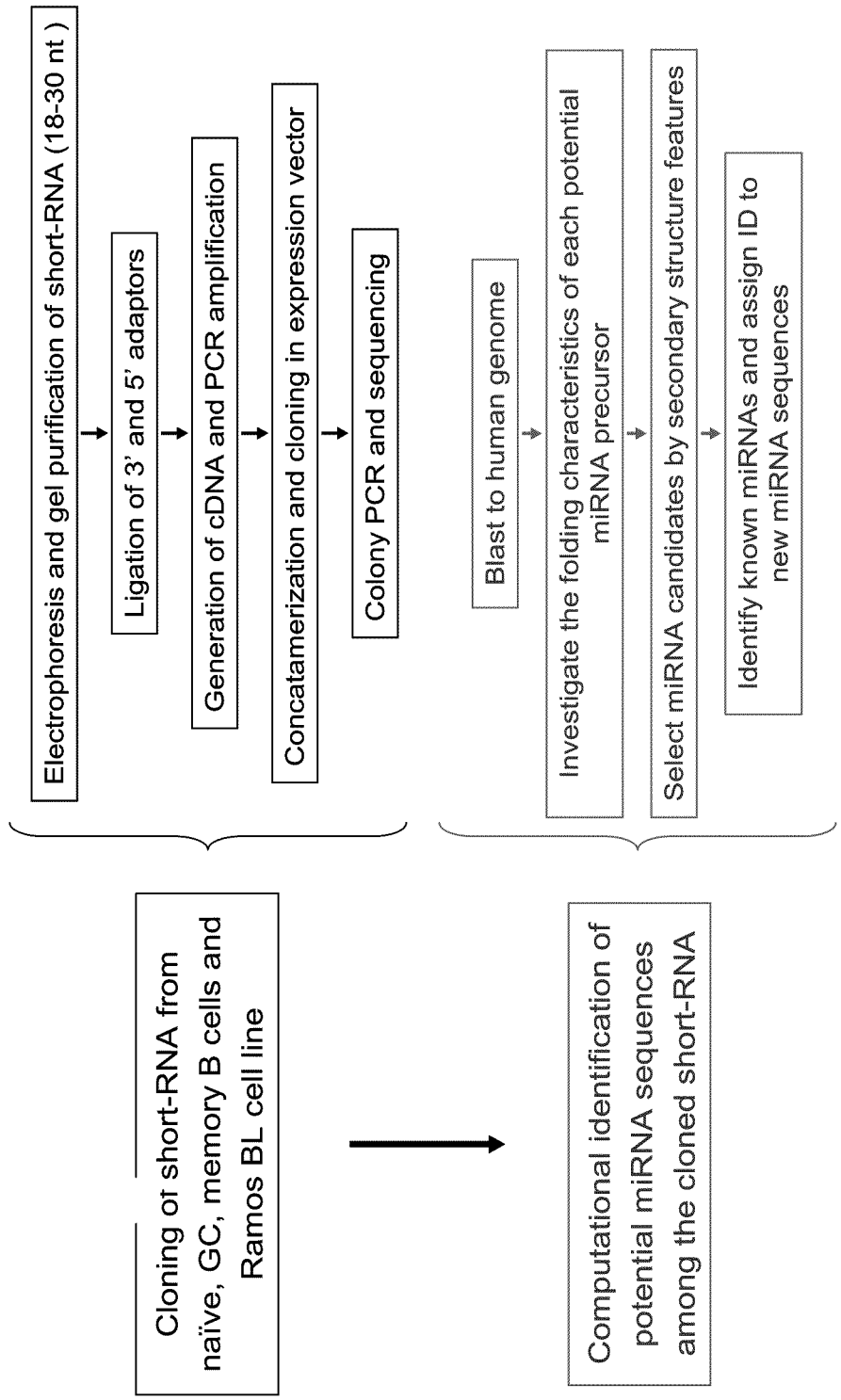
FIG. 10 is a schematic depicting the experimental procedure. The experimental approach includes two main steps: cloning and sequencing of short-RNA and computational analysis of sequences in order to identify potential miRNAs.

Short-RNA libraries were generated by cloning RNA fractions of 18-30 nt from human centroblasts, naïve and memory B cells purified from tonsils as well as from the Burkitt lymphoma cell line Ramos, which is representative of malignant transformation of GC B cells (FIG. 10). Approximately 3,500 sequences were analyzed from each library, corresponding to 13,991 total short-RNAs (2,661 non-redundant sequences). Using a bootstrap approach[16,17], we estimated the expected number of miRNAs that could be predicted using our computational pipeline from various size of short-RNA libraries. The results suggested that at the current sequencing depth, 80% of the possible predictions have been identified FIG. 17).

Figure 11:
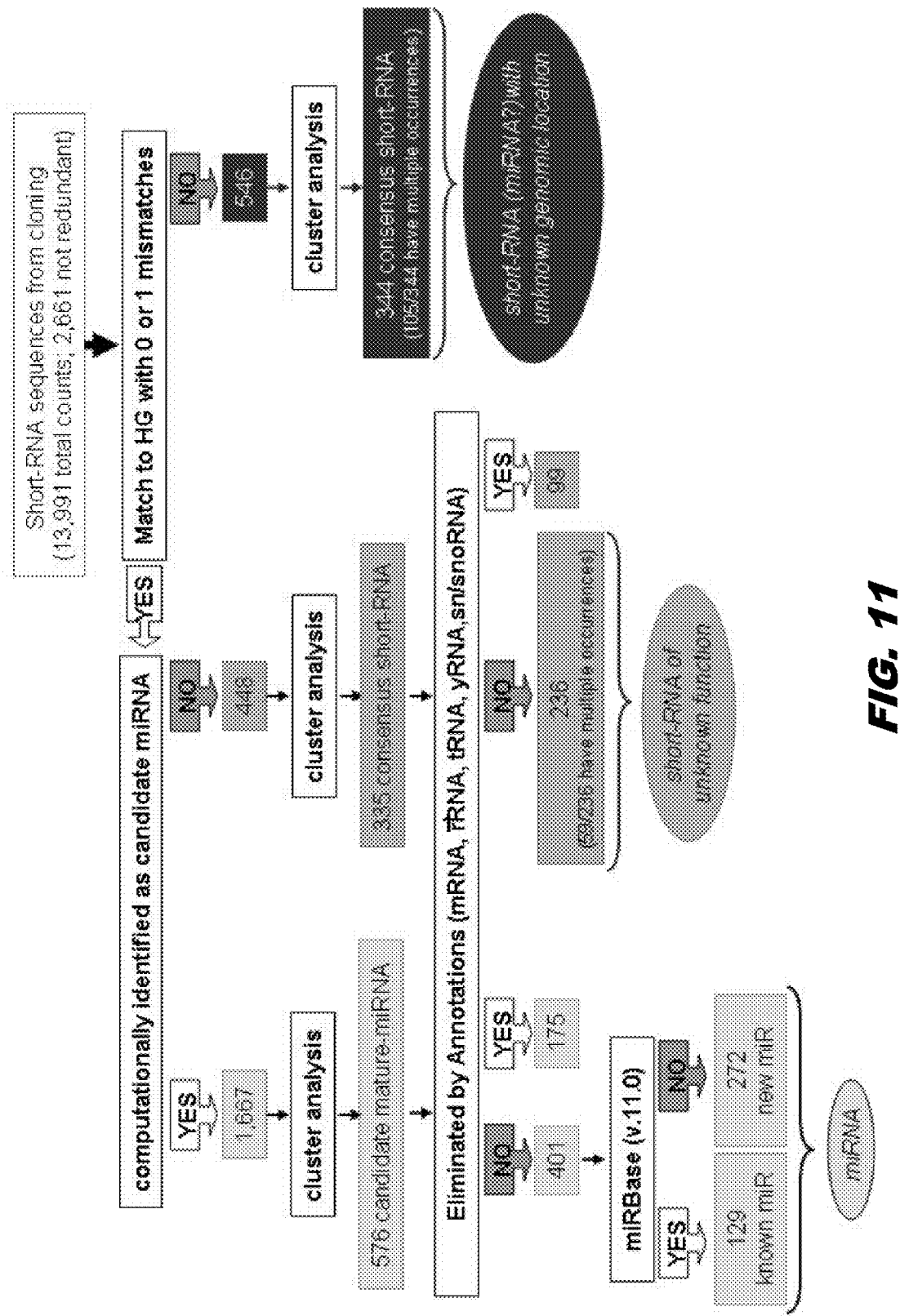
FIG. 11 is a diagram representing the Computational analysis of short-RNA libraries. Short-RNA sequences were grouped in three main categories: miRNAs, short-RNAs of unknown function and short-RNAs not matching the human genome. Short-RNA sequences were aligned to the human genome (hg18 assembly) and if a favorable match was identified the sequences were subject to computational identification of candidate miRNAs. Short-RNAs which aligned in the same genomic location were clustered and considered as supporting sequences for the same miRNA. Annotations were used to eliminate RNA aligning with mRNA, tRNA, rRNA and other non-coding RNA species. Overall, 401 unique candidate mature miRNA were identified and compared to the miRBase database to detect previously reported miRNA. Among the short-RNAs lacking miRNA features 30% were annotated and the remaining might represent a part of the transcriptome whose functions are still unknown. Short-RNAs which could be matched to the human genome only with 2 or more mismatches were considered as potential short-RNA or miRNA with unknown genomic locations.

The cloned sequences were matched to the human genome assembly from March 2006 (hg18) to retrieve the genomic regions from which the short-RNAs originated. One or more genomic locations were identified for approximately 80% of the cloned sequences considering both perfect matches and single mismatches. Consistent with previous observations, 3'-end mismatches were the most common and showed a clear preference for A in the last position ([18]. Approximately 546 short-RNA sequences did not align to the human genome according to the above criteria and are likely due to PCR errors introduced during the cloning procedure (FIG. 11). Nevertheless, a small subset of these short-RNAs lacking a corresponding genomic region in *Homo sapiens* have been cloned with high frequencies in multiple libraries and showed differential expression during B cell differentiation, suggesting they may represent bona fide short-RNA species. However, given the difficulty of assigning genomic coordinates to these sequences they were omitted from further analyses.

Computational Prediction of miRNA Precursors

Figure 18:
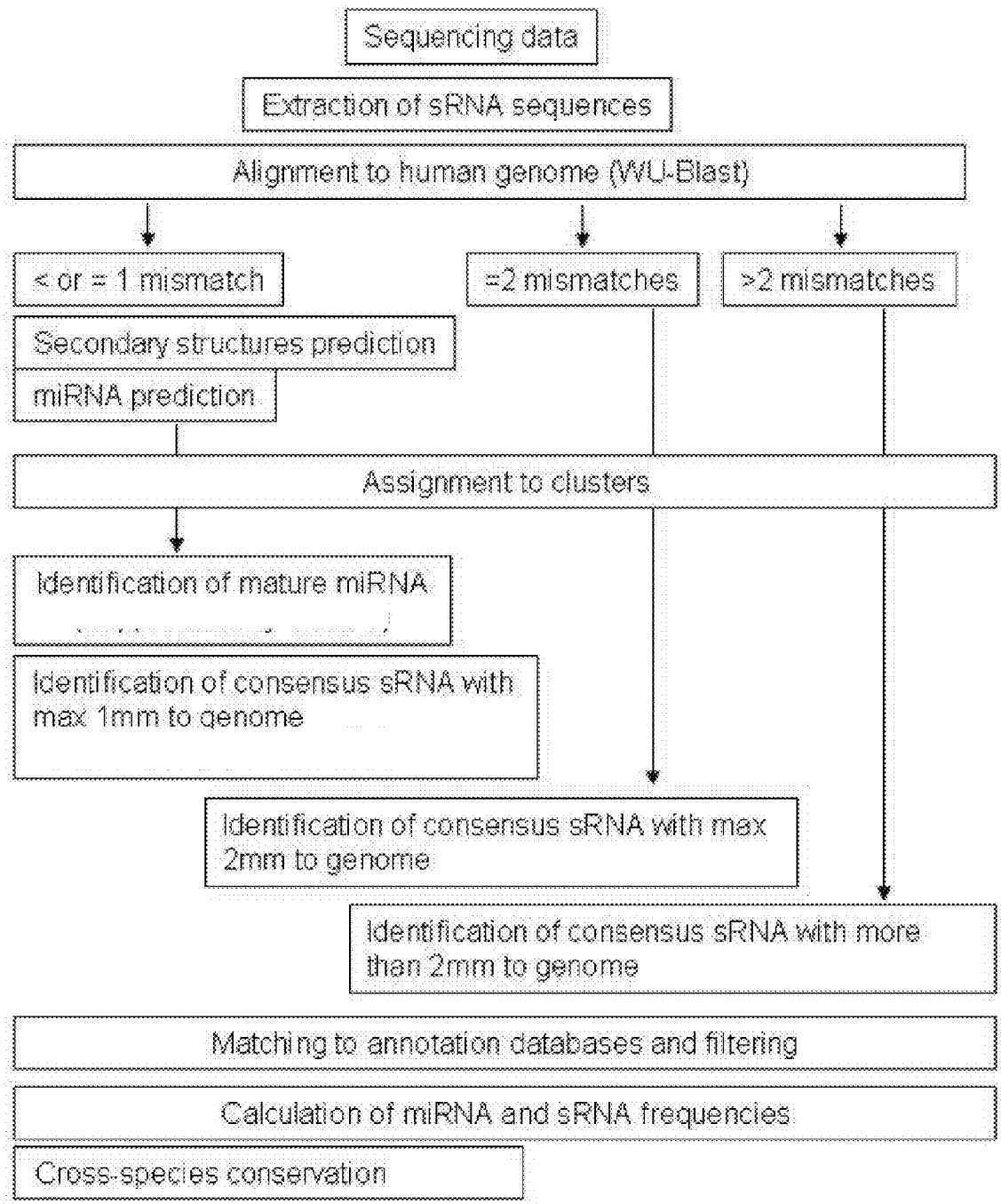
FIG. 18 is flow chart depicting an overview of computational analysis for the short RNA libraries.

In order to identify candidate miRNAs among the cloned sequences, we developed a computational pipeline aiming at the identification of potential miRNA precursors based on the investigation of their genomic location and folding characteristics (FIG. 18 and Supplementary Methods). Briefly, short RNA sequences were mapped to the human genome and candidate genomic precursors (+/−90 nt) were then retrieved and analyzed for secondary structure, size and energy of the loop, and number of complimentary base pairs in the stem of the loop (Supplementary Methods). The prediction was performed on the full set of non redundant short-RNAs (2,115 sequences) for which one or more genomic locations could be identified (FIG. 11). The analysis led to the identification of candidate precursors for 1,667 short-RNA sequences, which were then clustered to account for the variability observed at the miRNA 3'-ends (and less dramatically at the 5'-ends) including nucleotide substitutions and deletions. Moreover, editing of miRNA has been previously reported[19,20] and a few cases compatible with an editing process have been observed in the libraries described here. Since most clusters of short-RNA are affected by these modifications, we applied the following criteria in order to define mature miRNA sequences: i) each nucleotide must occur in more than 50% of the cloned sequences; sequences supported by a short-RNA set that is fully contained in a larger set were eliminated while matching clusters with partial containment were merged (Supplementary Methods). After annotating each candidate mature miRNA, those which had evidences of originating from mRNA, rRNA, tRNA and other ncRNA (yRNA, sn/snoRNA) and occurred once were eliminated. Overall, the computational analysis identified 401 mature miRNA (Table 1).

Figure 12:
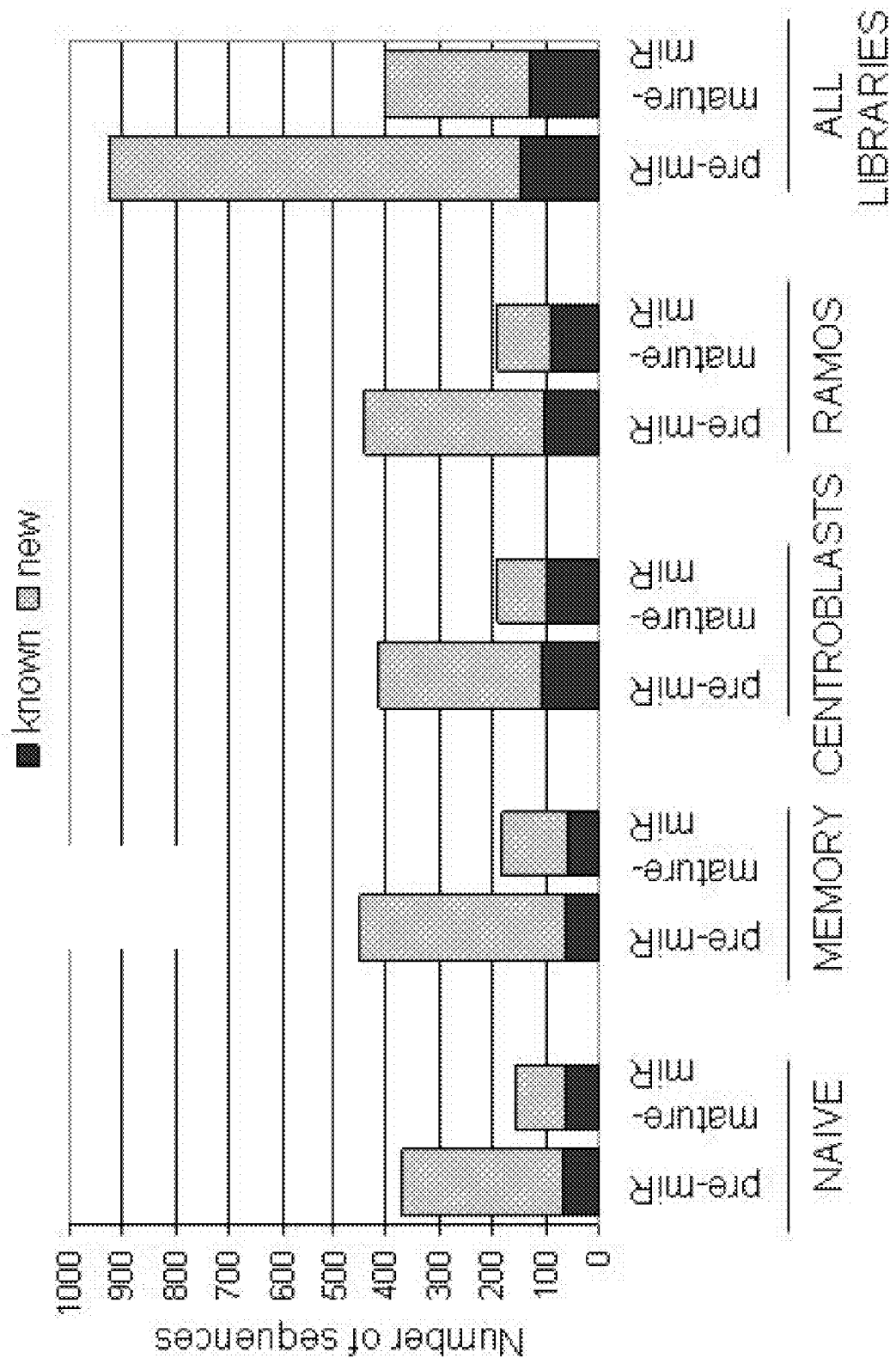
FIG. 12 is a bar graph depicting a computational prediction of precursors and mature miRNA. The number of predicted precursor miRNAs (pre-miR) and mature miRNAs (mature-miR) are plotted independently for each library and overall. The sequences matching miRNAs deposited in the miRBase database (v.11.0) are defined as "known" and conversely the sequences not previously reported are named "new".

The human miRNAs deposited in the miRBase database (v.11.0) were identified only at the end of the analysis and any lack of prediction was checked by matching the starting set with the final predictions. Overall, previously reported miRNA represented 32% of cloned and computationally validated mature miRNA. In addition, our analysis identified 146 previously reported precursors as well as 761 genomic locations containing precursors potentially coding for 272 new mature miRNA and 19 new precursors for 8 mature miRNAs deposited in the miRBase database (FIG. 12 and Table 1).

TABLE 1A

List of known and newly identified mature miRINAs.

| ID | SEQ ID NO. | Mature miRNA sequence | Annotations |
|---|---|---|---|
| CU-1026 | 1 | TGTAGTGTTTCCTACTTTATGGA | Mature:hsa-miR-142-3p:MIMAT0000434 |
| CU-1064 | 2 | TAGCTTATCAGACTGATGTTGA | Mature:hsa-miR-21:MIMAT0000076 |
| CU-1061 | 3 | TAAAGTGCTTATAGTGCAGGTAG | Mature:hsa-miR-20a:MIMAT0000075 |
| CU-1035 | 4 | TAGCAGCACATCATGGTTTACA | Mature:hsa-miR-15b:MIMAT0000417 |

TABLE 1A-continued

List of known and newly identified mature miRINAs.

| ID | SEQ ID NO. | Mature miRNA sequence | Annotations |
|---|---|---|---|
| CU-1037 | 5 | TAGCAGCACGTAAATATTGGCG | Mature:hsa-miR-16:MIMAT0000069 |
| CU-1001 | 6 | TGAGGTAGTAGGTTGTATAGTT | Mature:hsa-let-7a:MIMAT0000062 |
| CU-1116 | 7 | TATTGCACTTGTCCCGGCCTGT | Mature:hsa-miR-92a:MIMAT0000092 |
| CU-1018 | 8 | TCCCACCGCTGCCACCA | Mature:hsa-miR-1280:MIMAT0005946 |
| CU-1006 | 9 | TGAGGTAGTAGATTGTATAGTT | Mature:hsa-let-7f:MIMAT0000067 |
| CU-1079 | 10 | TAGCACCATCTGAAATCGGTTA | Mature:hsa-miR-29a:MIMAT0000086 |
| CU-1033 | 11 | TAGCAGCACATAATGGTTTGT | Mature:hsa-miR-15a:MIMAT0000068 |
| CU-1124 | 12 | CCCATAAAGTAGAAAGCACTA | Mature:hsa-miR-142-5p:MIMAT0000433 |
| CU-1007 | 13 | TGAGGTAGTAGTTTGTACAGTT | Mature:hsa-let-7g:MIMAT0000414 |
| CU-1008 | 14 | TGAGGTAGTAGTTTGTGCTGTT | Mature:hsa-let-7i:MIMAT0000415 |
| CU-1082 | 15 | TAGCACCATTTGAAATCGGTTA | Mature:hsa-miR-29c:MIMAT0000681 |
| CU-1085 | 16 | TGTAAACATCCTACACTCTCAGC | Mature:hsa-miR-30c:MIMAT0000244 |
| CU-1039 | 17 | CAAAGTGCTTACAGTGCAGGTAG | Mature:hsa-miR-17:MIMAT0000070 |
| CU-1071 | 18 | CATTGCACTTGTCTCGGTCTGA | Mature:hsa-miR-25:MIMAT0000081 |
| CU-1046 | 19 | CAACGGAATCCCAAAAGCAGCTG | Mature:hsa-miR-191:MIMAT0000440 |
| CU-1057 | 20 | TGTGCAAATCCATGCAAAACTGA | Mature:hsa-miR-19b:MIMAT0000074 |
| CU-1024 | 21 | TACCACAGGGTAGAACCACGGA | Mature:hsa-miR-140-3p:MIMAT0004597 |
| CU-1084 | 22 | TGTAAACATCCTACACTCAGCT | Mature:hsa-miR-30b:MIMAT0000420 |
| CU-1003 | 23 | TGAGGTAGTAGGTTGTGTGGTT | Mature:hsa-let-7b:MIMAT0000063 |
| CU-1080 | 24 | TAGCACCATTTGAAATCAGTGTT | Mature:hsa-miR-29b:MIMAT0000100 |
| CU-1012 | 25 | TAAAGTGCTGACAGTGCAGAT | Mature:hsa-miR-106b:MIMAT0000680 |
| CU-1092 | 26 | TCCCTGTCCTCCAGGAGCTC | Mature:hsa-miR-339-5p:MIMAT0000764 |
| CU-1072 | 27 | TTCAAGTAATCCAGGATAGGCT | Mature:hsa-miR-26a:MIMAT0000082 |
| CU-1118 | 28 | CAAAGTGCTGTTCGTGCAGGTAG | Mature:hsa-miR-93:MIMAT0000093 |
| CU-1067 | 29 | TGTCAGTTTGTCAAATACCCCA | Mature:hsa-miR-223:MIMAT0000280 |
| CU-1027 | 30 | TGAGAACTGAATTCCATGGGTT | Mature:hsa-miR-146a:MIMAT0000449 |
| CU-1029 | 31 | TCTCCCAACCCTTGTACCAGT | Mature:hsa-miR-150:MIMAT0000451 |
| CU-1015 | 32 | TCCCTGAGACCCTAACTTGTGA | Mature:hsa-miR-125b:MIMAT0000423 |
| CU-1093 | 33 | TCTCACACAGAAATCGCACCCGTC | Mature:hsa-miR-342-3p:MIMAT0000753 |
| CU-1016 | 34 | GTCCCTGTTCGGGCGCCA | Mature:hsa-miR-1274b:MIMAT0005938 |
| CU-1056 | 35 | TGTGCAAATCTATGCAAAACTGA | Mature:hsa-miR-19a:MIMAT0000073 |
| CU-1086 | 36 | TGTAAACATCCCCGACTGGAAG | Mature:hsa-miR-30d:MIMAT0000245 |
| CU-1065 | 37 | AGCTACATTGTCTGCTGGGTT | Mature:hsa-miR-221:MIMAT0000278 |
| CU-1004 | 38 | AGAGGTAGTAGGTTGCATAGTT | Mature:hsa-let-7d:MIMAT0000065 |
| CU-1011 | 39 | CCGCACTGTGGGTACTTGCT | Star:hsa-miR-106b*:MIMAT0004672 |
| CU-1010 | 40 | AGCAGCATTGTACAGGGCTATGA | Mature:hsa-miR-103:MIMAT0000101 |
| CU-1050 | 41 | AACTGGCCCTCAAAGTCCCGCT | Mature:hsa-miR-193b:MIMAT0002819 |

TABLE 1A-continued

List of known and newly identified mature miRINAs.

| ID | SEQ ID NO. | Mature miRNA sequence | Annotations |
|---|---|---|---|
| CU-1091 | 42 | GCCCCTGGGCCTATCCTAGAA | Mature:hsa-miR-331-3p:MIMAT0000760 |
| CU-1023 | 43 | AGCTGGTGTTGTGAATCAGGCCGT | Mature:hsa-miR-138:MIMAT0000430 |
| CU-1101 | 44 | TGAGGGGCAGAGAGCGAGACTT | Mature:hsa-miR-423-5p:MIMAT0004748 |
| CU-1066 | 45 | AGCTACATCTGGCTACTGGGTCT | Mature:hsa-miR-222:MIMAT0000279 |
| CU-1017 | 46 | GTGGGGAGAGGCTGTA | Mature:hsa-miR-1275:MIMAT0005929 |
| CU-5001 | 47 | CTATACGACCTGCTGCCTTTC | Star:hsa-let-7d*:MIMAT0004484 |
| CU-1032 | 48 | TTAATGCTAATCGTGATAGGGGT | Mature:hsa-mIR-155:MIMAT0000646 |
| CU-1108 | 49 | AGGGGGAAAGTTCTATAGTC | Mature:hsa-miR-625:MIMAT0003294 |
| CU-1055 | 50 | ACAGTAGTCTGCACATTGGTT | Mature:hsa-miR-199b-3p:MIMAT0004563 |
| CU-1042 | 51 | AACATTCAACGCTGTCGGTGAGTT | Mature:hsa-miR-181a:MIMAT0000256 |
| CU-1113 | 52 | TGGAAGACTAGTGATTTTGTTGT | Mature:hsa-miR-7:MIMAT0000252 |
| CU-1098 | 53 | TAATGCCCCTAAAAATCCTTAT | Mature:hsa-miR-365:MIMAT0000710 |
| CU-1052 | 54 | TAGCAGCACAGAAATATTGGCA | Mature:hsa-miR-195:MIMAT0000461 |
| CU-1568 | 55 | TGAGGTAGTAGGTTGTAT | Mature:hsa-let-7c:MIMAT0000064 |
| CU-1103 | 56 | TCCTGTACTGAGCTGCCCCGAG | Mature:hsa-miR-486-5p:MIMATOOO2177 |
| CU-1014 | 57 | TCCCTGAGACCCTTTAACCTGTGA | Mature:hsa-miR-125a-5p:MIMAT0000443 |
| CU-1068 | 58 | ATCACATTGCCAGGGATTTCCA | Mature:hsa-miR-23a:MIMAT0000078 |
| CU-1019 | 59 | TCACAGTGAACCGGTCTCTTT | Mature:hsa-mIR-128:MIMAT0000424 |
| CU-1076 | 60 | CACTAGATTGTGAGCTCCTGGA | Mature:hsa-miR-28-3p:MIMAT0004502 |
| CU-1111 | 61 | CAACAAATCACAGTCTGCCAT | Star:hsa-miR-7-1*:MIMAT0004553 |
| CU-1062 | 62 | CAAAGTGCTTATAGTGCAGGTAG | Mature:hsa-miR-20b-mm:MIMAT0001413 |
| CU-1115 | 63 | AGGTTGGGATCGGTTGCAATGCT | Star:hsa-miR-92a-1*:MIMAT0004507 |
| CU-1126 | 64 | TCATTCATTGCTGTCGGTGGGTT | Mature:hsa-mir-181b-1:MI0000270 |
| CU-1096 | 65 | TCCCCCAGGTGTGATTCTGATT | Mature:hsa-miR-361-3p:MIMAT0004682 |
| CU-1054 | 66 | CCCAGTGTTCAGACTACCTGTTC | Mature:hsa-miR-199a-5p:MIMAT0000231 |
| CU-1125 | 67 | ACCAATATTACTGTGCTGCTT | Star:hsa-miR-16-2*:MIMAT0004518 |
| CU-1087 | 68 | TGTAAACATCCTTGACTGGAAGCT | Mature:hsa-miR-30e:MIMAT0000692 |
| CU-1045 | 69 | TAAGGTGCATCTAGTGCAGATA | Mature:hsa-miR-18a:MIMAT0000072 |
| CU-1069 | 70 | ATCACATTGCCAGGGATTACCA | Mature:hsa-miR-23b:MIMAT0000418 |
| CU-1044 | 71 | ACTGCCCTAAGTGCTCCTTCTG | Star:hsa-miR-18a*:MIMAT0002891 |
| CU-1083 | 72 | TGTAAACATCCTCGACTGGA | Mature:hsa-miR-30a:MIMAT0000087 |
| CU-1009 | 73 | TACAGTACTGTGATAACTGAAG | Mature:hsa-miR-101:MIMAT0000099 |
| CU-1030 | 74 | CTAGACTGAAGCTCCTTGAGG | Mature:hsa-miR-151-3p:MIMAT0000757 |
| CU-1095 | 75 | TGGCAGTGTCTTAGCTGGTTGTT | Mature:hsa-miR-34a:MIMAT0000255 |
| CU-1119 | 76 | TGAGGTAGTAAGTTGTATTGTT | Mature:hsa-miR-98:MIMAT0000096 |
| CU-1028 | 77 | TGAGAACTGAATTCCATAGGCTGT | Mature:hsa-miR-146b-5p:MIMAT0002809 |
| CU-1031 | 78 | TCGAGGAGCTCACAGTCTAGTA | Mature:hsa-miR-151-5p:MIMAT0004697 |
| CU-1100 | 79 | AGCTCGGTCTGAGGCCCCTCAG | Mature:hsa-miR-423-3p:MIMAT0001340 |

TABLE 1A-continued

List of known and newly identified mature miRINAs.

| ID | SEQ ID NO. | Mature miRNA sequence | Annotations |
|---|---|---|---|
| CU-1038 | 80 | ACTGCAGTGAAGGCACTTGTAG | Star:hsa-miR-17*:MIMAT0000071 |
| CU-1040 | 81 | ACCATCGACCGTTGATTGTA | Star:hsa-miR-181a*:MIMAT0000270 |
| CU-1053 | 82 | TCACCACCTTCTCCACCCAG | Mature:hsa-miR-197:MIMAT0000227 |
| CU-1075 | 83 | TCACAGTGGCTAAGTTCTG | Mature:hsa-miR-27b:MIMAT0000419 |
| CU-1073 | 84 | TCAAGTAATTCAGGATAGGTT | Mature:hsa-miR-26b:MIMAT0000083 |
| CU-1100 | 85 | GGGTTTACGTTGGGAGAACT | Mature:hsa-miR-629:MIMAT0004810 |
| CU-1088 | 86 | TGGGTTGAGAGGGCGA | Mature:hsa-miR-320a:MIMAT0000510 |
| CU-1005 | 87 | TGAGGTAGGAGGTTGTATAGTT | Mature:hsa-let-7e:MIMAT0000066 |
| CU-1081 | 88 | TGACCGATTTCTCCTGGTGTT | Star:hsa-miR-29c*:MIMAT0004673 |
| CU-1117 | 89 | TATTGCACTCGTCCCGGCC | Mature:hsa-miR-92b:MIMAT0003218 |
| CU-1094 | 90 | GGGGTGCTATCTGTGATTGA | Mature:hsa-miR-342-5p:MIMAT0004694 |
| CU-1021 | 91 | GCATGGGTGGTTCAGTGGTAGAA | Mature:hsa-miR-1308:MIMAT0005947 |
| CU-1089 | 92 | CTGGCCCTCTCTGCCCTT | Mature:hsa-miR-328:MIMAT0000752 |
| CU-1047 | 93 | CTGACCTATGAATTGACAGC | Mature:hsa-miR-192:MIMAT0000222 |
| CU-1099 | 94 | CTCCTGACTCCAGGTCCTGTG | Star:hsa-miR-378*:MIMAT0000731 |
| CU-1105 | 95 | CGTCAACACTTGCTGGTT | Mature:hsa-miR-505:MIMAT0002876 |
| CU-1034 | 96 | CGAATCATTATTTGCTGCTCT | Star:hsa-miR-15b*:MIMAT0004586 |
| CU-5002 | 97 | CATCGGGAATGTCGTGTCCGCC | Star:hsa-mir-425*:MI0001448 |
| CU-1025 | 98 | CAGTGGTTTTACCCTATGGTA | Mature:hsa-miR-140-5p:MIMAT0000431 |
| CU-1022 | 99 | CAGTGCAATGATGAAAGGGCAT | Mature:hsa-miR-130b:MIMAT0000691 |
| CU-1104 | 100 | CAGCAGCACACTGTGGTTTGT | Mature:hsa-miR-497:MIMAT0002820 |
| CU-1106 | 101 | CACGCTCATGCACACACCCAC | Mature:hsa-miR-574-3p:MIMAT0003239 |
| CU-1077 | 102 | AAGGAGCTCACAGTCTATTGAG | Mature:hsa-miR-28-5p:MIMAT0000085 |
| CU-1123 | 103 | TTGGTCCCCTTCAACCAGCTGT | Mature:hsa-miR-133a:MIMAT0000427 |
| CU-1074 | 104 | TTCACAGTGGCTAAGTTCCGA | Mature:hsa-miR-27a:MIMAT0000084 |
| CU-1097 | 105 | TTATCAGAATCTCCAGGGGTAA | Mature:hsa-miR-361-5p:MIMAT0000703 |
| CU-1043 | 106 | TGGAGAGAAAGGCAGTTCCTGAT | Mature:hsa-miR-185:MIMAT0000455 |
| CU-1112 | 107 | TGAGACCTCTGGGTTCTGAGCT | Mature:hsa-miR-769-5p:MIMAT0003886 |
| CU-1122 | 108 | TCTTTGGTTATCTAGCTGTATGA | Mature:hsa-miR-9:MIMAT0000441 |
| CU-1109 | 109 | TCTAGTAAGAGTGGCAGTCGA | Mature:hsa-miR-628-3p:MIMAT0003297 |
| CU-1090 | 110 | TATTGCACATTACTAAGTTGA | Mature:hsa-miR-32:MIMAT0000090 |
| CU-1013 | 111 | TAAGGCACGCGGTGAATGCCA | Mature:hsa-miR-124:MIMAT0000422 |
| CU-1058 | 112 | TAACACTGTCTGGTAACGATGTT | Mature:hsa-miR-200a:MIMAT0000682 |
| CU-1059 | 113 | GTGAAATGTTTAGGACCACTAG | Mature:hsa-miR-203:MIMAT0000264 |
| CU-1102 | 114 | GCAGTCCATGGGCATATACACA | Mature:hsa-miR-455-3p:MIMAT0004784 |
| CU-1107 | 115 | GAGCTTATTCATAAAAGTGCAG | Mature:hsa-miR-590-5p:MIMAT00032 |
| CU-1114 | 116 | CTGCCCTGGCCCGAGGGACCGA | Mature:hsa-miR-874:MIMAT0004911 |

TABLE 1A-continued

List of known and newly identified mature miRINAs.

| ID | SEQ ID NO. | Mature miRNA sequence | Annotations |
|---|---|---|---|
| CU-1002 | 117 | CTATACAACCTACTGCCTTC | Star:hsa-let-7b*:MIMAT00044 |
| CU-1049 | 118 | CGGGGTTTTGAGGGCGAGATGA | Star:hsa-miR-193b*:MIMAT0004767 |
| CU-1051 | 119 | CCAGTGGGCTGCTGTTATCTG | Star:hsa-miR-194*:MIMAT0004671 |
| CU-1036 | 120 | CCAGTATTAACTGTGCTGCTGA | Star:hsa-miR-16-1*:MIMAT0004489 |
| CU-1121 | 121 | CACCCGTAGAACCGACCTTGCG | Mature:hsa-miR-99b:MIMAT0000689 |
| CU-1120 | 122 | CAAGCTCGTGTCTGTGGGTCCG | Star:hsa-miR-99b*:MIMAT0004678 |
| CU-1063 | 123 | CAACACCAGTCGATGGGCTGTA | Star:hsa-miR-21*:MIMAT0004494 |
| CU-1070 | 124 | AGGCGGAGACTTGGGCAATT | Star:hsa-miR-25*:MIMAT0004498 |
| CU-1060 | 125 | ACTGCATTATGAGCACTTAAAGT | Star:hsa-miR-20a*:MIMAT0004493 |
| CU-1078 | 126 | ACTGATTTCTTTTGGTGTTCA | Star:hsa-miR-29a*:MIMAT0004503 |
| CU-1020 | 127 | ACTCGGCGTGGCGTCGGTCGTGG | Mature:hsa-miR-1307:MIMAT0005951 |
| CU-1041 | 128 | ACCACTGACCGTTGACTGTAC | Star:hsa-miR-181a-2*:MIMAT0004558 |
| CU-1048 | 129 | AACTGGCCTACAAAGTCCCAGT | Mature:hsa-miR-193a-3p:MIMAT0000459 |
| CU-1127 | 130 | TGTCTGAGCGTCGCT | preCursor:hsa-mir-1826:MI0008194 |
| CU-1132 | 131 | GCCGGGTACTTTCGTATTTT | NEW |
| CU-1137 | 132 | GCTAAGGAAGTCCTGTGCTCAGTTTT | NEW |
| CU-1130 | 133 | CCCGGGTTTCGGCACCA | NEW |
| CU-1136 | 134 | TCGGGCGGGAGTGGTGGCTTT | NEW |
| CU-1383 | 135 | TAGAGGCACCGCCTGCCCA | NEW |
| CU-1131 | 136 | CGGGGCGCGGCCTCGCTG | NEW |
| CU-1135 | 137 | CCCACGGGGTCTCCGGGCGAG | NEW |
| CU-1392 | 138 | CCCACGGGAAACAGCA | NEW |
| CU-1133 | 139 | CAGCCCGGCCTGGCTCCTCCAT | NEW |
| CU-1134 | 140 | CACGGAAGGTGGCCCGG | NEW |
| CU-1170 | 141 | CTGTAGGCACCTGAAA | NEW |
| CU-1153 | 142 | CCCCCCACTGCTAAATTTGACTGGCTT | NEW |
| CU-1191 | 143 | GCCCGCATCCTCCACCA | NEW |
| CU-1140 | 144 | CCCGGCCAACGCACCA | NEW |
| CU-1173 | 145 | ATCCCACTCCTGACACCA | NEW |
| CU-1149 | 146 | CCGGGCGGAAACACCA | NEW |
| CU-1159 | 147 | TGTCAGTTTGTTAATTA | NEW |
| CU-1178 | 148 | AGGGTGTGCGTGTTTTT | NEW |
| CU-1142 | 149 | TCGATTCCCGGCCCATGCACCA | NEW |
| CU-1164 | 150 | TGAGAGCGCTCGGTTTTT | NEW |
| CU-1148 | 151 | TGGTGTGGTCTGTTGTTTT | NEW |
| CU-1221 | 152 | TGTGCTCCGGAGTTACCTCGTTT | NEW |
| CU-1186 | 153 | TCCCCGACACCTCCACCA | NEW |
| CU-1224 | 154 | CTGTAGGCATCATCAAT | NEW |

TABLE 1A-continued

List of known and newly identified mature miRINAs.

| ID | SEQ ID NO. | Mature miRNA sequence | Annotations |
|---|---|---|---|
| CU-1180 | 155 | AACCGAGCGTCCAAGCTCTTTCCATTTT | NEW |
| CU-1155 | 156 | TCCCCGCACCTCCACCA | NEW |
| CU-1212 | 157 | TCCCCGGCACTTCCACCA | NEW |
| CU-1213 | 158 | TCACCCCATAAACACCA | NEW |
| CU-1193 | 159 | CTGTAGGCACCATCATAA | NEW |
| CU-1202 | 160 | CCCACCAGAGTCGCCA | NEW |
| CU-1220 | 161 | TTCCCCGACGGGGAGCCA | NEW |
| CU-1175 | 162 | GGCGTGATTCATACCTTTT | NEW |
| CU-1194 | 163 | GCGGGCGGACCTTTT | NEW |
| CU-1205 | 164 | CGGCTCGAAGGACCA | NEW |
| CU-1187 | 165 | CCCCGGCCCCGCGTA | NEW |
| CU-1206 | 166 | CCCACCTCTGACACCA | NEW |
| CU-1210 | 167 | CCACGAGGTCGGCCGG | NEW |
| CU-1156 | 168 | CAGGATCGGCCCACT | NEW |
| CU-1197 | 169 | ATGTGGTGGCTTACTTTT | NEW |
| CU-1183 | 170 | ATCCCGGACGAGCCCA | NEW |
| CU-1570 | 171 | ATCCCCAGCATCTCCACCA | NEW |
| CU-1146 | 172 | AGAAAGGCCGAATTTTA | NEW |
| CU-1165 | 173 | TGTCAGTTTTTACCCAA | NEW |
| CU-1160 | 174 | TGTCAGTTTGAACCCAA | NEW |
| CU-1189 | 175 | TGTAGTGTTTCTTACTTTA | NEW |
| CU-1219 | 176 | TGGCGAAGGTCGGCCGCG | NEW |
| CU-1203 | 177 | TGCAGGGCCGGCGGGAGG | NEW |
| CU-1211 | 178 | TCGGGCGGCGGGCGT | NEW |
| CU-1190 | 179 | TCGGCTTTCCCTGCTAACTGGGCTTTTT | NEW |
| CU-1144 | 180 | TCAGAGCGCGGGCCGACCCC | NEW |
| CU-1376 | 181 | TCAACACCCACTCCCTC | NEW |
| CU-1138 | 182 | TATCAATGATGCTTCTGAGA | NEW |
| CU-1384 | 183 | TAACCCCAGGGTTGGTCA | NEW |
| CU-1154 | 184 | GGGGTCCCCGGTAGA | NEW |
| CU-1171 | 185 | GGGCGTGGGTGTGATGATTC | NEW |
| CU-1199 | 186 | GGGAGGTGAGTAGGTCTG | NEW |
| CU-1226 | 187 | GGAGACGTGGCCGAGAG | NEW |
| CU-1572 | 188 | GCGGAATACCACGGGGA | NEW |
| CU-1151 | 189 | GCAGGCGGGGATTAGCTA | NEW |
| CU-1227 | 190 | GCAGCGGAACGTCGGCGCGC | NEW |
| CU-1200 | 191 | GACGTCACCCTCCTCA | NEW |

TABLE 1A-continued

List of known and newly identified mature miRINAs.

| ID | SEQ ID NO. | Mature miRNA sequence | Annotations |
|---|---|---|---|
| CU-1152 | 192 | CTTGGACTAACCTGGTGTA | NEW |
| CU-1158 | 193 | CTGTAGGCCACCATCCA | NEW |
| CU-1216 | 194 | CTGTAGGCACCACCA | NEW |
| CU-1188 | 195 | CTGGTAGGCACCTGAAA | NEW |
| CU-1157 | 196 | CTGATGTTGATGCATATGATGACA | NEW |
| CU-1207 | 197 | CGGTGGAACCTGCATTGGTTT | NEW |
| CU-1181 | 198 | CGGGGCCGGGGCTAGGGT | NEW |
| CU-1185 | 199 | CGGGCCGCCCCGCCCACCG | NEW |
| CU-1163 | 200 | CGGGCCCCGGGGCTCG | NEW |
| CU-1366 | 201 | CGGCCTATCCGGAATGCCCC | NEW |
| CU-1225 | 202 | CGGACCTCCCTGGCCC | NEW |
| CU-1145 | 203 | CGCGGCCAGTGTCCCCTTGTA | NEW |
| CU-1201 | 204 | CGACACACGGCCCGTGGCGC | NEW |
| CU-1141 | 205 | CCTCATAAATACCGG | NEW |
| CU-1172 | 206 | CCTCACTGGGGGCTCCA | NEW |
| CU-1209 | 207 | CCTCACCTGGAGCACCA | NEW |
| CU-1147 | 208 | CCGTACTGGCCACCA | NEW |
| CU-1223 | 209 | CCGCCGCCCCCCCCT | NEW |
| CU-1217 | 210 | CCGCCCCGACCTTAGCTA | NEW |
| CU-1176 | 211 | CCCGTCCGCTGCGCCA | NEW |
| CU-1139 | 212 | CCCGTCCACTCCGCCA | NEW |
| CU-1166 | 213 | CCCCGGCCCATGCACCA | NEW |
| CU-1177 | 214 | CCCCGGCATCTCCATCA | NEW |
| CU-1214 | 215 | CCCCAGTACCTCCACCA | NEW |
| CU-1184 | 216 | CCCAGCGGTGCCTCCA | NEW |
| CU-1574 | 217 | CCACGCTCTGCTACCA | NEW |
| CU-1360 | 218 | CCACCCTGGAGCCTCCGT | NEW |
| CU-1150 | 219 | ATGGTAGGCACCTGAAA | NEW |
| CU-1162 | 220 | ATGGGCGGTCCTCGTT | NEW |
| CU-1179 | 221 | ATGGCCTGGACCCCACTCCT | NEW |
| CU-1161 | 222 | ATGGCCGCATATATTTT | NEW |
| CU-1218 | 223 | ATCCTGTTCGTGACGCCA | NEW |
| CU-1204 | 224 | ATCCTGCTCACAGCCCCA | NEW |
| CU-1168 | 225 | AGCGAGGGTTCCGCCGGCC | NEW |
| CU-1195 | 226 | ACTGGGGAGGGGAGGAGCCTCGAGG | NEW |
| CU-1215 | 227 | ACCCCGAGGGGACGGGCG | NEW |
| CU-1208 | 228 | ACAGCGCTGTGTTCCCGT | NEW |
| CU-1192 | 229 | ACAAAAAAAAAAGCCCAACCCT | NEW |

TABLE 1A-continued

List of known and newly identified mature miRINAs.

| ID | SEQ ID NO. | Mature miRNA sequence | Annotations |
|---|---|---|---|
| CU-1373 | 230 | AACTAAAACCCCTACGCA | NEW |
| CU-1196 | 231 | AAAGGAGCCGAATCTTT | NEW |
| CU-1251 | 232 | CCCACCCAGGGACGCCA | refseqGeneIntron-annotate |
| CU-1254 | 233 | CCCCGGCACCTCCACCA | refseqGeneIntron-annotate |
| CU-1298 | 234 | ATCCCGGACGAGCCCCCA | refseqGeneIntron-annotate |
| CU-1229 | 235 | CCCACGTTGGGCGCCA | refseqGeneIntron-annotate |
| CU-1276 | 236 | TCGATTCCCGGCCAATGCACCA | refseqGeneIntron-annotate |
| CU-1303 | 237 | TCCCACTTCTGACACCA | refseqGeneIntron-annotate |
| CU-1270 | 238 | TCGTAGGCACCTGAAA | refseqGeneIntron-annotate |
| CU-1242 | 239 | TCCCCGTACGGGCCACCA | refseqGeneIntron-annotate |
| CU-1273 | 240 | TTGACCGCTCTGACCA | refseqGeneIntron-annotate |
| CU-1328 | 241 | CCCAGCGGGGCCTCCA | refseqGeneIntron-annotate |
| CU-1257 | 242 | CAGGAACGGTGCACCA | mRNAaLL-annotate;refseqGeneIntron-annotate |
| CU-1241 | 243 | AGTCCCATCTGGGTCGCCA | refseqGeneIntron-annotate |
| CU-1575 | 244 | CCCCCCACTGCTAAATTTGACTGGA | refseqGeneIntron-annotate;rnaGene-annotate |
| CU-1274 | 245 | GTTTGTTAATTAACCCAA | refseqGeneIntron-annotate |
| CU-1243 | 246 | GTCCCTTCGTGGTCGCCA | refseqGeneIntron-annotate |
| CU-1284 | 247 | CTGTAGCACCTGAAA | mRNAall-annotate; refseqGeneIntron-annotate;rnaGene-annotate |
| CU-1300 | 248 | TCCTCACACGGGGCACCA | refseqGeneIntron-annotate |
| CU-1278 | 249 | TAACGGCCGCGGTACCC | refseqGeneIntron-annotate |
| CU-1264 | 250 | GAGGGGGACCAAAAAAAA | refseqGeneIntron-annotate |
| CU-1275 | 251 | CCCGCATTCTCCACCA | refseqGeneIntron-annotate |
| CU-1246 | 252 | GGGGGGTAAAAAAAAA | refseqGeneIntron-annotate |
| CU-1315 | 253 | TCCACCGCTGCCACCA | refseqGeneIntron-annotate |
| CU-1277 | 254 | GAGCCATGATGATACCACTGAGC | refseqGeneIntron-annotate |
| CU-1288 | 255 | CGTCCATGATGTTCCGCAA | mRNAall-annotate;snoRNA-annotate;piRNA-annotate; wgRNA-annotate;refseqGeneIntron-annotate |
| CU-1234 | 256 | CATCCTCTGCTACCA | mRNAall-annotate;refseqGeneIntron-annotate; exEID-annotate |
| CU-1345 | 257 | AGAACACTACGAGCCACA | mRNA-annotate;refseqGeneIntron-annotate |
| CU-1352 | 258 | ACCCCACTTCTGGTACCA | refseqGeneIntron-annotate |
| CU-1323 | 259 | TGTATTGTGAGACATTC | mRNAall-annotate;refseqGeneIntron-annotate; wgRNA-annotate;rnaGene-annotate |
| CU-1324 | 260 | TCTCGGTGGAACCTCCA | refseqGeneIntron-annotate |
| CU-1302 | 261 | TCCCCGGCACCTCCAA | refseqGeneIntron-annotate |
| CU-1269 | 262 | TACCGAGCCTGGTGATAGC | refseqGeneIntron-annotate |
| CU-1281 | 263 | GCAGCGCCAGCCTCCCGCCCTAC | refseqGeneIntron-annotate |
| CU-1292 | 264 | CCGCCTGGGGAGTAC | refseqGeneIntron-annotate |

TABLE 1A-continued

List of known and newly identified mature miRINAs.

| ID | SEQ ID NO. | Mature miRNA sequence | Annotations |
|---|---|---|---|
| CU-1339 | 265 | ATCCCCAGCACCTCCACCA | refseqGeneIntron-annotate |
| CU-1293 | 266 | AGCAGTGATGTCCTGAAAATTCTGAAG | refseqGeneIntron-annotate |
| CU-1307 | 267 | ACCCCACTATGCTTAGCCCT | mRNA-annotate;refseqGeneIntron-annotate |
| CU-1294 | 268 | AAAGGACCTGGCGGTGCTTC | mRNA-annotate;refseqGeneIntron-annotate |
| CU-1325 | 269 | TTGCCACACTGCAACACCTT | refseqGeneIntron-annotate |
| CU-1333 | 270 | TTCCTTGGATGTCTGAGTGAC | refseqGeneIntron-annotate |
| CU-1310 | 271 | TTAACCACCAAGATCGCTGATGCAC | refseqGeneIntron-annotate |
| CU-1299 | 272 | TGTTCGCCGACCGTTGA | refseqGeneIntron-annotate |
| CU-1265 | 273 | TGGGGTCTGGGAGGGA | refseqGeneIntron-annotate |
| CU-1322 | 274 | TGGGAGAGCAGGGTATTGT | refseqGeneIntron-annotate |
| CU-1279 | 275 | TGCAGATGATGTAAAGA | snoRNA-annotate;refseqGeneIntron-annotate; wgRNA-annotate;rnaGene-annotate |
| CU-1267 | 276 | TCGCTATGATGATGGATTCCAAAA | mRNAall-annotate;refseqGeneIntron-annotate; rnaGene-annotate |
| CU-1308 | 277 | TCCGAAAGGCCTCCCGCACCG | refseqGeneIntron-annotate |
| CU-1331 | 278 | TCCCGCACCTCCACCA | refseqGeneIntron-annotate |
| CU-1297 | 279 | TAGATGAATAGGTAAAGAG | refseqGeneIntron-annotate |
| CU-1235 | 280 | GTGTATGATGACCTCATGTAGCCTGAAC | refseqGeneIntron-annotate |
| CU-1253 | 281 | GTGAAGCGTTCCATATTTTT | mRNAall-annotate;refseqGeneIntron-annotate; rnaGene-annotate |
| CU-1348 | 282 | GGGGGGGGGTTTGGAA | refseqGeneIntron-annotate |
| CU-1337 | 283 | GGGGGGAGGGAAGGCAA | refseqGeneIntron-annotate |
| CU-1316 | 284 | GGGGGCTGGGCTGGGTA | refseqGeneIntron-annotate |
| CU-1343 | 285 | GGGGCCGCCGCCTGTGT | refseqGeneIntron-annotate |
| CU-1326 | 286 | GGGAGTCCGCGGCGAGC | refseqGeneIntron-annotate |
| CU-1329 | 287 | GGGACCTGGGGACCA | refseqGeneIntron-annotate |
| CU-1286 | 288 | GGCTTGGTCTAGGGGTA | refseqGeneIntron-annotate |
| CU-1332 | 289 | GGCTGGGACCCTGGACAC | refseqGeneIntron-annotate |
| CU-1262 | 290 | GGCGACCTGCGACTCCTT | refseqGeneIntron-annotate |
| CU-1236 | 291 | GGAGGGGGGAAACAAA | refseqGeneIntron-annotate |
| CU-1317 | 292 | GGAGGGGGGAAAAAAAAA | computGene-annotate;refseqGeneIntron-annotate |
| CU-1327 | 293 | GGAAGACCTGCACCACTGTC | mRNAall-annotate;computGene-annotate; refseqGeneIntron-annotate;exeID-annotate |
| CU-1239 | 294 | GCGGGTGTCAGGCCT | refseqGeneIntron-annotate |
| CU-1266 | 295 | GCCGGGCGTGGTGGTCTG | refseqGeneIntron-annotate |
| CU-1261 | 296 | GCCGCCGAGACCCCAGGACCC | refseqGeneIntron-annotate |
| CU-1260 | 297 | GCAGCCGTGCTTTTA | refseqGeneIntron-annotate |
| CU-1259 | 298 | GCAAATGATGCCCTCTGATC | refseqGeneIntron-annotate |
| CU-1349 | 299 | GAGGGGGTCAAAAAAA | refseqGeneIntron-annotate |
| CU-1272 | 300 | CTTGATGATGAGCAGGATCTGAGT | refseqGeneIntron-annotate |

TABLE 1A-continued

List of known and newly identified mature miRINAs.

| ID | SEQ ID NO. | Mature miRNA sequence | Annotations |
|---|---|---|---|
| CU-1341 | 301 | CTGTAGGCACTGAAA | refseqGeneIntron-annotate |
| CU-1231 | 302 | CTGTAGGCACCATTAA | refseqGeneIntron-annotate |
| CU-1313 | 303 | CTGCTTAAGTCCTGACCAG | refseqGeneIntron-annotate |
| CU-1296 | 304 | CTGAGCACCTTTCCCTTCC | refseqGeneIntron-annotate |
| CU-1291 | 305 | CTAGCCCCAAACCCA | piRNA-annotate;refseqGeneIntron-annotate |
| CU-1245 | 306 | CGGTCACACGATTAACCCA | mRNA-annotate;refseqGeneIntron-annotate |
| CU-1338 | 307 | CGGGGGGAGGAAAAAA | refseqGeneIntron-annotate |
| CU-1268 | 308 | CGGGGGGAAAAAAAAA | refseqGeneIntron-annotate |
| CU-1290 | 309 | CGGGGCCGCACGCGC | refseqGeneIntron-annotate |
| CU-1319 | 310 | CGGGAGTGGGGTGGCGCCCAG | refseqGeneIntron-annotate |
| CU-1318 | 311 | CGGGAGCCCCGGGTT | refseqGeneIntron-annotate |
| CU-1569 | 312 | CGGACCTGATAAATTCCCAC | refseqGeneIntron-annotate |
| CU-1320 | 313 | CGCGGCTCTTGCGGT | refseqGeneIntron-annotate |
| CU-1249 | 314 | CGCCTGAGTCAGAAC | refseqGeneIntron-annotate |
| CU-1240 | 315 | CGCCGCCGCCCCCCCC | mRNAall-annotate;refseqGeneIntron-annotate; exEID-annotate |
| CU-1351 | 316 | CCTTCCTTGGATGTCTGAGTGAG | mRNAall-annotate;refseqGeneIntron-annotate; wgRNA-annotate;rnaGene-annotate |
| CU-1354 | 317 | CCTCGCTGGGGCCTCCA | refseqGeneIntron-annotate |
| CU-1233 | 318 | CCTCACAGGGACGCCA | refseqGeneIntron-annotate |
| CU-1289 | 319 | CCTAGGAGTGCGACAATT | mRNAall-annotate;refseqGeneIntron-annotate; wgRNA-annotate;rnaGene-annotate |
| CU-1283 | 320 | CCGCTCTGAGACCTA | refseqGeneIntron-annotate |
| CU-1228 | 321 | CCGCCCGTCACCCTCCTCAAGTA | mRNA-annotate;refseqGeneIntron-annotate |
| CU-1344 | 322 | CCCGGGCGGCACACCA | refseqGeneIntron-annotate |
| CU-1271 | 323 | CCCGCGGGCTTGCTGGGCGTCCC | refseqGeneIntron-annotate |
| CU-1321 | 324 | CCCCTGCGATTTCCCCA | refseqGeneIntron-annotate;rnaGene-annotate |
| CU-1285 | 325 | CCCCGGCATCTCCACTA | refseqGeneIntron-annotate |
| CU-1571 | 326 | CCCCAGTGAGTGCCCTCTTCC | refseqGeneIntron-annotate |
| CU-1353 | 327 | CCCAGAGACGCCGTCCTCGA | refseqGeneIntron-annotate |
| CU-1355 | 328 | CCCACCGAGGATGCCA | refseqGeneIntron-annotate |
| CU-1238 | 329 | CCATCACTACCCACCA | refseqGeneIntron-annotate |
| CU-1347 | 330 | CCACTCCAGCCTAGCCCC | refseqGeneIntron-annotate |
| CU-1295 | 331 | CAGTACAGGCACACCTC | refseqGeneIntron-annotate |
| CU-1256 | 332 | CACGTCGGGGTCCCCA | refseqGeneIntron-annotate |
| CU-1250 | 333 | CACGATTAACCCAAGTC | mRNA-annotate;refseqGeneIntron-annotate |
| CU-1305 | 334 | CACCACACCCGGGCCA | refseqGeneIntron-annotate |
| CU-1287 | 335 | CAACACAGGCATGCT | refseqGeneIntron-annotate |
| CU-1314 | 336 | ATAGGGTTTACGACCTCGATGTTGGATCA | refseqGeneIntron-annotate |

TABLE 1A-continued

List of known and newly identified mature miRNAs.

| ID | SEQ ID NO. | Mature miRNA sequence | Annotations |
|---|---|---|---|
| CU-1311 | 337 | ATACCATGATGAACAATAGCTGAGA | refseqGeneIntron-annotate |
| CU-1282 | 338 | AGGGTTCAGCTGTCTC | refseqGeneIntron-annotate |
| CU-1350 | 339 | AGGCTGTGATGGACCTGGCTGAGCCTG | refseqGeneIntron-annotate |
| CU-1252 | 340 | AGAGAGTAGGGGGAGGT | refseqGeneIntron-annotate |
| CU-1334 | 341 | ACTGTCCCTGTCTACTA | refseqGeneIntron-annotate |
| CU-1340 | 342 | ACCGCATCTGGCCTATTTTT | refseqGeneIntron-annotate |
| CU-1342 | 343 | ACCAGACCTCCTGTGCGAAG | refseqGeneIntron-annotate |
| CU-1304 | 344 | ACAGCCCGGATCCCAGCCCACTTA | refseqGeneIntron-annotate |
| CU-1230 | 345 | ACACTGAGCCACAACCCA | refseqGeneIntron-annotate |
| CU-1312 | 346 | AAGGGCTTGGCTTAATTA | refseqGeneIntron-annotate |
| CU-1255 | 347 | AACCCGGAAGGCGGAGGTTGCGG | computGene-annotate;refseqGeneIntron-annotate |
| CU-1336 | 348 | AACCCCACACCAACC | refseqGeneIntron-annotate |
| CU-1346 | 349 | AACAAGCTTCTTTGACGTCCCATCCAC | refseqGeneIntron-annotate |
| CU-1369 | 350 | TCCCCGGCATCTCCACCA | computGene-annotate |
| CU-1370 | 351 | CTGATTGCTCCTGTCTGATT | mRNAall-annotate;exEID-annotate;rnaGene-annotate |
| CU-1371 | 352 | TCTAGAGGAGCCTGTTCTGTA | mRNA-annotate |
| CU-1381 | 353 | TCGATTCCCGGTCAGGGAACCA | repeats-annotate |
| CU-1380 | 354 | ATAGGTTTGGTCCTAGCCTTTCT | piRNA-annotate |
| CU-1363 | 355 | CGTTCGCGCTTTCCCCTG | rnaGene-annotate |
| CU-1396 | 356 | TAAGTGTTTGTGGGTTA | rnaGene-annotate |
| CU-1361 | 357 | GGCGGCGGGAGACCCA | computGene-annotate |
| CU-1359 | 358 | CCCCGGCAGGTTTGA | rnaGene-annotate |
| CU-1573 | 359 | TGCCGTGATCGTATAGTGGTTA | piRNA-annotate |
| CU-1169 | 360 | TCAGACTACTCTCCTCCGCCCATT | mRNAall-annotate |
| CU-1167 | 361 | GGACACAGAGGCTTCG | mRNAall-annotate |
| CU-1395 | 362 | CTGACAGCCGGGGTTTTGGA | computGene-annotate |
| CU-1365 | 363 | CGGCGGGGCCTGGAGTCTG | mRNAall-annotate;computGene-annotate;exEID-annotate |
| CU-1375 | 364 | CCTGGCTCGCTGCGCCA | computGene-annotate |
| CU-1182 | 365 | CCGCCCCACCCCGCGCGC | mRNAall-annotate;exEID-annotate |
| CU-1174 | 366 | CCCGAACGCTGCCAACCC | exEID-annotate |
| CU-1385 | 367 | AGACCCGCGGGCGCTCTCCAGTC | rnaGene-annotate |
| CU-1524 | 368 | CCCCCACAACCGCGCTTGACTAGC | mRNAall-annotate;yRNA-eliminate;rnaGene-annotate |
| CU-1453 | 369 | CCCTGCTCGCTGCGCCA | refseqGeneExon-eliminate |
| CU-1477 | 370 | CTCCCACTGCTTCACTTGACTAGC | yRNA-eliminate;refseqGeneIntron-annotate; rnaGene-annotate |
| CU-1466 | 371 | CCCATCCTCGTCGCCA | refseqGeneExon-eliminate |
| CU-1222 | 372 | TCACGTCGGGGTCACCA | Morozov-eliminate |

TABLE 1A-continued

List of known and newly identified mature miRINAs.

| ID | SEQ ID NO. | Mature miRNA sequence | Annotations |
|---|---|---|---|
| CU-1388 | 373 | TCCCTGGTGGTCTAGTGGTTAGGATTCG | tRNAcomputational-annotate;rnaGene-annotate;HStRNA-eliminate;piRNA-annotate |
| CU-1428 | 374 | GGTAGCGTGGCCGAG | RNAcomputational-annotate;tRNA-eliminate;HStRNA-eliminate;rnaGene-annotate |
| CU-1488 | 375 | TCCTGCCGCGGTCGCCA | refseqGeneExon-eliminate |
| CU-1557 | 376 | GGAGAGAACGCGGTCTGAGTGGT | snoRNA-eliminate;wgRNA-annotate;rnaGene-annotate |
| CU-1379 | 377 | TCGGGTGCGAGAGGTCCCGGGT | tRNAcomputational-annotate;HStRNA-eliminate;rnaGene-annotate |
| CU-1542 | 378 | GGCTGGTCCGATGGTAGTGGGTT | mRNAall-annotate;yRNA-eliminate;refseqGeneIntron-annotate;rnaGene-annotate |
| CU-1550 | 379 | CGGAAGCGTGCTGGGCCC | tRNAcomputational-annotate;tRNA-eliminate;rnaGene-annotate;HStRNAeliminate;piRNA-annotate |
| CU-1232 | 380 | CCCGGGCGGCGCACCA | Morozov-eliminate;refseqGeneIntron-annotate |
| CU-1513 | 381 | GCGGGTGATGCGAACTGGAGTCTGAGC | computGene-annotate;snoRNA-annotate;snoRNA-eliminate; wgRNA-annotate;rnaGene-annotate |
| CU-1368 | 382 | GACGAGGTGGCCGAGTGG | tRNAcomputational-annotate;rnaGene-annotate;HStRNA-eliminate;piRNA-annotate |
| CU-1474 | 383 | GGGGGTGTAGCTCAG | RNAcomputational-annotate;tRNA-eliminate;rnaGene-annotate;HStRNA-eliminate;piRNA-annotate |
| CU-1470 | 384 | CTCCTGGCTGGCTCGCCA | mRNAall-annotate;computGene-annotate;refseqGeneExon-eliminate;exEID-annotate |
| CU-1471 | 385 | CGGGAGGCCCGGGTT | rnaGene-annotate;tRNAcomputational-annotate;piRNA-annotate;tRNAeliminate;refseqGeneIntron-annotate;mRNA-annotate;HStRNA-eliminate |
| CU-1538 | 386 | GGCTGGTCCGAGTGCAGTGGTGTTTA | yRNA-eliminate;refseqGeneIntron-annotate;rnaGene-annotate |
| CU-1486 | 387 | CTGCTGTGATGACATTC | computGene-annotate;snoRNA-annotate;snoRNA-eliminate;wgRNA-annotate;rnaGene-annotate |
| CU-1386 | 388 | GTCACGCGGGAGACC | RNAcomputational-annotate;mRNAall-annotate;rnaGene-annotate;HStRNA-eliminate;piRNA-annotate |
| CU-1382 | 389 | CCTCGTTAGTATAGTGGTGAGTATCCC | tRNAcomputational-annotate;rnaGene-annotate;HStRNA-eliminate;piRNA-annotate |
| CU-1433 | 390 | GGCCGGTTAGCTCAG | mRNAall-annotate;exE ID-annotate;rnaGene-annotate;tRNAcomputational-annotate;piRNA-annotate;refseqGeneIntron-annotate;refseqGeneExon-eliminate;HStRNA-eliminate |
| CU-1403 | 391 | GCATTGGTGGTTCAGTGGTAGA | rnaGene-annotate;tRNAcomputational-annotate;piRNA-annotate;tRNA-eliminate;refseqGeneIntron-annotate;HStRNA-eliminate |
| CU-1362 | 392 | CTGTCACGCGGGAGA | RNAcomputational-annotate;mRNAall-annotate;rnaGene-annotate;HStRNA-eliminate;piRNA-annotate |
| CU-1490 | 393 | CTACGGGGATGATTTT | mRNAall-annotate;snoRNA-annotate;snoRNA-eliminate;wgRNA-annotate;rnaGene-annotate |
| CU-1469 | 394 | CCAGGGGCTGAGGGCA | snoRNA-eliminate;refseqGeneIntron-annotate;wgRNA-annotate |
| CU-1457 | 395 | TCTCACTACTGCACTTGACTA | mRNAall-annotate;yRNA-eliminate;refseqGeneIntron-annotate;exEID-annotate;rnaGene-annotate |
| CU-1440 | 396 | GGTTATCACGTTCGCC | RNAcomputational-annotate;tRNA-eliminate;rnaGene-annotate;HStRNA-eliminate;piRNA-annotate |
| CU-1528 | 397 | AGGGGTATGATTCTCGCT | tRNAcomputational-annotate;tRNA-eliminate;HStrNA-eliminate;rnaGene-annotate |

TABLE 1A-continued

List of known and newly identified mature miRINAs.

| ID | SEQ ID NO. | Mature miRNA sequence | Annotations |
|---|---|---|---|
| CU-1545 | 398 | CCACGAGGAAGAGAGGTAGC | snoRNA-eliminate;wgRNA-annotate;snoRNA-annotate |
| CU-1244 | 399 | GTCAGGATGGCCGAGCGGTCT | RNAcomputational-annotate;rnaGene-annotate;HStRNA-eliminate;refseqGeneIntron-annotate |
| CU-1390 | 400 | GGGGATGTAGCTCAG | tRNAcomputational-annotate;rnaGene-annotate;HStRNA-eliminate;piRNA-annotate |
| CU-1377 | 401 | GCAGCGATGGCCGAG | tRNAcomputational-annotate;HStRNA-eliminate;rnaGene-annotate |

TABLE 1B

List of known and newly identified mature miRNAs including information on frequencies.

| | | Corrected Counts | | | | Frequencies | | | |
|---|---|---|---|---|---|---|---|---|---|
| Mature miRNA sequence | SEQ ID NO. | Naïve (N) | Memory (M) | Centroblasts (CB) | Ramos (RA) | Naïve (N) | Memory (M) | Centroblasts (CB) | Ramos (RA) |
| TGTAGTGTTTCCTACTTTATGGA | 1 | 1329 | 592 | 635 | 391 | 38.5 | 19.83 | 24.93 | 16.02 |
| TAGCTTATCAGACTGATGTTGA | 2 | 196 | 353 | 144 | 13 | 5.68 | 11.83 | 5.65 | 0.53 |
| TAAAGTGCTTATAGTGCAGGTAG | 3 | 54 | 19 | 49.82 | 257.89 | 1.56 | 0.64 | 1.96 | 10.57 |
| TAGCAGCACATCATGGTTTACA | 4 | 38 | 61 | 176.84 | 105 | 1.1 | 2.04 | 6.94 | 4.3 |
| TAGCAGCACGTAAATATTGGCG | 5 | 131 | 97 | 53 | 35 | 3.79 | 3.25 | 2.08 | 1.43 |
| TGAGGTAGTAGGTTGTATAGTT | 6 | 62.84 | 78.99 | 92.19 | 63.25 | 1.82 | 2.65 | 3.62 | 2.59 |
| TATTGCACTTGTCCCGGCCTGT | 7 | 17 | 21 | 46 | 207 | 0.49 | 0.7 | 1.81 | 8.48 |
| TCCCACCGCTGCCACCA | 8 | 68 | 97 | 25 | 28 | 1.97 | 3.25 | 0.98 | 1.15 |
| TGAGGTAGTAGATTGTATAGTT | 9 | 41.28 | 44 | 64 | 51.38 | 1.2 | 1.47 | 2.51 | 2.11 |
| TAGCACCATCTGAAATCGGTTA | 10 | 78 | 60 | 42 | 22 | 2.26 | 2.01 | 1.65 | 0.9 |
| TAGCAGCACATAATGGTTTGT | 11 | 90 | 39 | 32.16 | 8 | 2.61 | 1.31 | 1.26 | 0.33 |
| CCCATAAAGTAGAAAGCACTA | 12 | 88 | 53 | 7 | 10 | 2.55 | 1.78 | 0.27 | 0.41 |
| TGAGGTAGTAGTTTGTACAGTT | 13 | 41.28 | 47 | 30.77 | 21.16 | 1.2 | 1.57 | 1.21 | 0.87 |
| TGAGGTAGTAGTTTGTGCTGTT | 14 | 23 | 24 | 32 | 42 | 0.67 | 0.8 | 1.26 | 1.72 |
| TAGCACCATTTGAAATCGGTTA | 15 | 44 | 41 | 16 | 1 | 1.27 | 1.37 | 0.63 | 0.04 |
| TGTAAACATCCTACACTCTCAGC | 16 | 27 | 25 | 26 | 20 | 0.78 | 0.84 | 1.02 | 0.82 |
| CAAAGTGCTTACAGTGCAGGTAG | 17 | 9 | 6 | 10.18 | 65.04 | 0.26 | 0.2 | 0.4 | 2.67 |
| CATTGCACTTGTCTCGGTCTGA | 18 | 11 | 9 | 34 | 39 | 0.32 | 0.3 | 1.33 | 1.6 |
| CAACGGAATCCCAAAAGCAGCTG | 19 | 17 | 21 | 36 | 18 | 0.49 | 0.7 | 1.41 | 0.74 |
| TGTGCAAATCCATGCAAAACTGA | 20 | 0 | 1 | 25 | 65 | 0 | 0.03 | 0.98 | 2.66 |
| TACCACAGGGTAGAACCACGGA | 21 | 31 | 22 | 17 | 21 | 0.9 | 0.74 | 0.67 | 0.86 |
| TGTAAACATCCTACACTCAGCT | 22 | 31 | 11 | 27 | 16 | 0.9 | 0.37 | 1.06 | 0.66 |
| TGAGGTAGTAGGTTGTGTGGTT | 23 | 19.48 | 19 | 29 | 5.08 | 0.56 | 0.64 | 1.14 | 0.21 |
| TAGCACCATTTGAAATCAGTGTT | 24 | 22 | 14 | 12 | 4 | 0.64 | 0.47 | 0.47 | 0.16 |
| TAAAGTGCTGACAGTGCAGAT | 25 | 7 | 6 | 13 | 26 | 0.2 | 0.2 | 0.51 | 1.07 |
| TCCCTGTCCTCCAGGAGCTC | 26 | 6 | 3 | 3 | 32 | 0.17 | 0.1 | 0.12 | 1.31 |

TABLE 1B-continued

List of known and newly identified mature miRNAs including information on frequencies.

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| TTCAAGTAATCCAGGATAGGCT | 27 | 2 | 8 | 13 | 16 | 0.06 | 0.27 | 0.51 | 0.66 |
| CAAAGTGCTGTTCGTGCAGGTAG | 28 | 9 | 2 | 13 | 14 | 0.26 | 0.07 | 0.51 | 0.57 |
| TGTCAGTTTGTCAAATACCCCA | 29 | 25 | 10 | 1 | 0 | 0.72 | 0.34 | 0.04 | 0 |
| TGAGAACTGAATTCCATGGGTT | 30 | 4 | 7 | 21 | 4 | 0.12 | 0.23 | 0.82 | 0.16 |
| TCTCCCAACCCTTGTACCAGT | 31 | 12 | 18 | 2 | 0 | 0.35 | 0.6 | 0.08 | 0 |
| TCCCTGAGACCCTAACTTGTGA | 32 | 0 | 1 | 28 | 2 | 0 | 0.03 | 1.1 | 0.08 |
| TCTCACACAGAAATCGCACCCGTC | 33 | 10 | 8 | 8 | 3 | 0.29 | 0.27 | 0.31 | 0.12 |
| GTCCCTGTTCGGGCGCCA | 34 | 12 | 10 | 6 | 1 | 0.35 | 0.34 | 0.24 | 0.04 |
| TGTGCAAATCTATGCAAAACTGA | 35 | 0 | 0 | 9 | 19 | 0 | 0 | 0.35 | 0.78 |
| TGTAAACATCCCCGACTGGAAG | 36 | 7 | 3 | 14 | 3 | 0.2 | 0.1 | 0.55 | 0.12 |
| AGCTACATTGTCTGCTGGGTT | 37 | 17 | 6 | 4 | 0 | 0.49 | 0.2 | 0.16 | 0 |
| AGAGGTAGTAGGTTGCATAGTT | 38 | 2 | 4 | 10 | 10 | 0.06 | 0.13 | 0.39 | 0.41 |
| CCGCACTGTGGGTACTTGCT | 39 | 8 | 6 | 2 | 8 | 0.23 | 0.2 | 0.08 | 0.33 |
| AGCAGCATTGTACAGGGCTATGA | 40 | 1 | 1 | 10 | 11 | 0.03 | 0.03 | 0.39 | 0.45 |
| AACTGGCCCTCAAAGTCCCGCT | 41 | 0 | 0 | 2 | 21 | 0 | 0 | 0.08 | 0.86 |
| GCCCCTGGGCCTATCCTAGAA | 42 | 1 | 0 | 10 | 10 | 0.03 | 0 | 0.39 | 0.41 |
| AGCTGGTGTTGTGAATCAGGCCGT | 43 | 0 | 0 | 15 | 5 | 0 | 0 | 0.59 | 0.2 |
| TGAGGGGCAGAGAGCGAGACTT | 44 | 5 | 1 | 7 | 4 | 0.14 | 0.03 | 0.27 | 0.16 |
| AGCTACATCTGGCTACTGGGTCT | 45 | 6 | 6 | 5 | 0 | 0.17 | 0.2 | 0.2 | 0 |
| GTGGGGAGAGGCTGTA | 46 | 2 | 6 | 3 | 5 | 0.06 | 0.2 | 0.12 | 0.2 |
| CTATACGACCTGCTGCCTTTC | 47 | 6 | 3 | 4 | 1 | 0.17 | 0.1 | 0.16 | 0.04 |
| TTAATGCTAATCGTGATAGGGGT | 48 | 3 | 4 | 5 | 1 | 0.09 | 0.13 | 0.2 | 0.04 |
| AGGGGGAAAGTTCTATAGTC | 49 | 0 | 2 | 0 | 11 | 0 | 0.07 | 0 | 0.45 |
| ACAGTAGTCTGCACATTGGTT | 50 | 0 | 0 | 13 | 0 | 0 | 0 | 0.51 | 0 |
| AACATTCAACGCTGTCGGTGAGTT | 51 | 0 | 0 | 7 | 6 | 0 | 0 | 0.27 | 0.25 |
| TGGAAGACTAGTGATTTTGTTGT | 52 | 1 | 1 | 1 | 8 | 0.03 | 0.03 | 0.04 | 0.33 |
| TAATGCCCCTAAAAATCCTTAT | 53 | 0 | 0 | 6 | 4 | 0 | 0 | 0.24 | 0.16 |
| TAGCAGCACAGAAATATTGGCA | 54 | 4 | 0 | 5 | 0 | 0.12 | 0 | 0.2 | 0 |
| TGAGGTAGTAGGTTGTAT | 55 | 0.11 | 0.01 | 0.01 | 0.13 | 0 | 0 | 0 | 0.01 |
| TCCTGTACTGAGCTGCCCCGAG | 56 | 0 | 0 | 7 | 1 | 0 | 0 | 0.27 | 0.04 |
| TCCCTGAGACCCTTTAACCTGTG | 57 | 0 | 0 | 8 | 0 | 0 | 0 | 0.31 | 0 |
| ATCACATTGCCAGGGATTTCCA | 58 | 0 | 0.5 | 7 | 0 | 0 | 0.02 | 0.27 | 0 |
| TCACAGTGAACCGGTCTCTTT | 59 | 1 | 0 | 0 | 6 | 0.03 | 0 | 0 | 0.25 |
| CACTAGATTGTGAGCTCCTGGA | 60 | 2 | 0 | 4 | 1 | 0.06 | 0 | 0.16 | 0.04 |
| CAACAAATCACAGTCTGCCAT | 61 | 3 | 0 | 1 | 3 | 0.09 | 0 | 0.04 | 0.12 |
| CAAAGTGCTTATAGTGCAGGTAG | 62 | 0 | 1 | 1 | 0.08 | 0 | 0.03 | 0.04 | 0 |
| AGGTTGGGATCGGTTGCAATGCT | 63 | 0 | 0 | 0 | 7 | 0 | 0 | 0 | 0.29 |

TABLE 1B-continued

List of known and newly identified mature miRNAs including information on frequencies.

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| ACATTCATTGCTGTCGGTGGGTT | 64 | 0 | 0 | 1 | 6 | 0 | 0 | 0.04 | 0.25 |
| TCCCCCAGGTGTGATTCTGATT | 65 | 4 | 1 | 0 | 1 | 0.12 | 0.03 | 0 | 0.04 |
| CCCAGTGTTCAGACTACCTGTTC | 66 | 0 | 0 | 6 | 0 | 0 | 0 | 0.24 | 0 |
| ACCAATATTACTGTGCTGCTT | 67 | 1 | 1 | 2 | 2 | 0.03 | 0.03 | 0.08 | 0.08 |
| TGTAAACATCCTTGACTGGAAGCT | 68 | 2 | 0 | 3 | 0 | 0.06 | 0 | 0.12 | 0 |
| TAAGGTGCATCTAGTGCAGATA | 69 | 0 | 0 | 1 | 4 | 0 | 0 | 0.04 | 0.16 |
| ATCACATTGCCAGGGATTACCA | 70 | 0 | 0.5 | 3 | 1 | 0 | 0.02 | 0.12 | 0.04 |
| ACTGCCCTAAGTGCTCCTTCTG | 71 | 0 | 0 | 0 | 5 | 0 | 0 | 0 | 0.2 |
| TGTAAACATCCTCGACTGGA | 72 | 1 | 0 | 3 | 0 | 0.03 | 0 | 0.12 | 0 |
| TACAGTACTGTGATAACTGAAG | 73 | 1 | 0 | 0 | 3 | 0.03 | 0 | 0 | 0.12 |
| CTAGACTGAAGCTCCTTGAGG | 74 | 2 | 1 | 1 | 0 | 0.06 | 0.03 | 0.04 | 0 |
| TGGCAGTGTCTTAGCTGGTTGTT | 75 | 0 | 1 | 2 | 0 | 0 | 0.03 | 0.08 | 0 |
| TGAGGTAGTAAGTTGTATTGTT | 76 | 0 | 1 | 1 | 1 | 0 | 0.03 | 0.04 | 0.04 |
| TGAGAACTGAATTCCATAGGCTGT | 77 | 1 | 0 | 2 | 0 | 0.03 | 0 | 0.08 | 0 |
| TCGAGGAGCTCACAGTCTAGTA | 78 | 1 | 0 | 1 | 1 | 0.03 | 0 | 0.04 | 0.04 |
| AGCTCGGTCTGAGGCCCCTCAG | 79 | 0 | 0 | 2 | 1 | 0 | 0 | 0.08 | 0.04 |
| ACTGCAGTGAAGGCACTTGTAG | 80 | 0 | 0 | 0 | 3 | 0 | 0 | 0 | 0.12 |
| ACCATCGACCGTTGATTGTA | 81 | 0 | 1 | 0 | 2 | 0 | 0.03 | 0 | 0.08 |
| TTCACCACCTTCTCCACCCAG | 82 | 0 | 0 | 0 | 2 | 0 | 0 | 0 | 0.08 |
| TTCACAGTGGCTAAGTTCTG | 83 | 0 | 0 | 2 | 0 | 0 | 0 | 0.08 | 0 |
| TTCAAGTAATTCAGGATAGGTT | 84 | 0 | 0 | 1 | 1 | 0 | 0 | 0.04 | 0.04 |
| TGGGTTTACGTTGGGAGAACT | 85 | 0 | 0 | 0 | 2 | 0 | 0 | 0 | 0.08 |
| TGGGTTGAGAGGGCGA | 86 | 1 | 0 | 1 | 0 | 0.03 | 0 | 0.04 | 0 |
| TGAGGTAGGAGGTTGTATAGTT | 87 | 0 | 0 | 1.02 | 0 | 0 | 0 | 0.04 | 0 |
| TGACCGATTTCTCCTGGTGTT | 88 | 2 | 0 | 0 | 0 | 0.06 | 0 | 0 | 0 |
| TATTGCACTCGTCCCGGCC | 89 | 0 | 0 | 1 | 1 | 0 | 0 | 0.04 | 0.04 |
| GGGGTGCTATCTGTGATTGA | 90 | 2 | 0 | 0 | 0 | 0.06 | 0 | 0 | 0 |
| GCATGGGTGGTTCAGTGGTAGA | 91 | 0 | 0 | 2 | 0 | 0 | 0 | 0.08 | 0 |
| CTGGCCCTCTCTGCCCTT | 92 | 0 | 0 | 1 | 1 | 0 | 0 | 0.04 | 0.04 |
| CTGACCTATGAATTGACAGC | 93 | 0 | 0 | 0 | 2 | 0 | 0 | 0 | 0.08 |
| CTCCTGACTCCAGGTCCTGTG | 94 | 0 | 0 | 0 | 2 | 0 | 0 | 0 | 0.08 |
| CGTCAACACTTGCTGGTT | 95 | 0 | 0 | 1 | 1 | 0 | 0 | 0.04 | 0.04 |
| CGAATCATTATTTGCTGCTCT | 96 | 0 | 0 | 1 | 1 | 0 | 0 | 0.04 | 0.04 |
| CATCGGGAATGTCGTGTCCGCC | 97 | 0 | 2 | 0 | 0 | 0 | 0.07 | 0 | 0 |
| CAGTGGTTTTACCCTATGGTA | 98 | 0 | 0 | 1 | 1 | 0 | 0 | 0.04 | 0.04 |
| CAGTGCAATGATGAAAGGGCAT | 99 | 0 | 0 | 2 | 0 | 0 | 0 | 0.08 | 0 |

TABLE 1B-continued

List of known and newly identified mature miRNAs including information on frequencies.

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| CAGCAGCACACTGTGGTTTGT | 100 | 0 | 0 | 2 | 0 | 0 | 0 | 0.08 | 0 |
| CACGCTCATGCACACACCCAC | 101 | 0 | 0 | 2 | 0 | 0 | 0 | 0.08 | 0 |
| AAGGAGCTCACAGTCTATTGAG | 102 | 0 | 0 | 2 | 0 | 0 | 0 | 0.08 | 0 |
| TTGGTCCCCTTCAACCAGCTGT | 103 | 0 | 0 | 1 | 0 | 0 | 0 | 0.04 | 0 |
| TTCACAGTGGCTAAGTTCCGA | 104 | 0 | 1 | 0 | 0 | 0 | 0.03 | 0 | 0 |
| TTATCAGAATCTCCAGGGGTAA | 105 | 1 | 0 | 0 | 0 | 0.03 | 0 | 0 | 0 |
| TGGAGAGAAAGGCAGTTCCTGAT | 106 | 0 | 0 | 1 | 0 | 0 | 0 | 0.04 | 0 |
| TGAGACCTCTGGGTTCTGAGCT | 107 | 0 | 0 | 0 | 1 | 0 | 0 | 0 | 0.04 |
| TCTTTGGTTATCTAGCTGTATGA | 108 | 0 | 0 | 0 | 1 | 0 | 0 | 0 | 0.04 |
| TCTAGTAAGAGTGGCAGTCGA | 109 | 0 | 0 | 0 | 1 | 0 | 0 | 0 | 0.04 |
| TATTGCACATTACTAAGTTGA | 110 | 1 | 0 | 0 | 0 | 0.03 | 0 | 0 | 0 |
| TAAGGCACGCGGTGAATGCCA | 111 | 1 | 0 | 0 | 0 | 0.03 | 0 | 0 | 0 |
| TAACACTGTCTGGTAACGATGTT | 112 | 0 | 0 | 0 | 1 | 0 | 0 | 0 | 0.04 |
| GTGAAATGTTTAGGACCACTAG | 113 | 0 | 0 | 1 | 0 | 0 | 0 | 0.04 | 0 |
| GCAGTCCATGGGCATATACACA | 114 | 0 | 0 | 1 | 0 | 0 | 0 | 0.04 | 0 |
| GAGCTTATTCATAAAAGTGCAG | 115 | 0 | 0 | 1 | 0 | 0 | 0 | 0.04 | 0 |
| CTGCCCTGGCCCGAGGGACCG | 116 | 0 | 0 | 0 | 1 | 0 | 0 | 0 | 0.04 |
| CTATACAACCTACTGCCTTC | 117 | 0 | 0 | 1 | 0 | 0 | 0 | 0.04 | 0 |
| CGGGGTTTTGAGGGCGAGATGA | 118 | 0 | 0 | 0 | 1 | 0 | 0 | 0 | 0.04 |
| CCAGTGGGGCTGCTGTTATCTG | 119 | 0 | 0 | 1 | 0 | 0 | 0 | 0.04 | 0 |
| CCAGTATTAACTGTGCTGCTGA | 120 | 0 | 0 | 0 | 1 | 0 | 0 | 0 | 0.04 |
| CACCCGTAGAACCGACCTTGCG | 121 | 0 | 0 | 1 | 0 | 0 | 0 | 0.04 | 0 |
| CAAGCTCGTGTCTGTGGGTCCG | 122 | 0 | 0 | 1 | 0 | 0 | 0 | 0.04 | 0 |
| CAACACCAGTCGATGGGCTGTA | 123 | 0 | 0 | 0 | 1 | 0 | 0 | 0 | 0.04 |
| AGGCGGAGACTTGGGCAATT | 124 | 0 | 0 | 0 | 1 | 0 | 0 | 0 | 0.04 |
| ACTGCATTATGAGCACTTAAAGT | 125 | 0 | 0 | 0 | 1 | 0 | 0 | 0 | 0.04 |
| ACTGATTTCTTTTGGTGTTCA | 126 | 0 | 0 | 0 | 1 | 0 | 0 | 0 | 0.04 |
| ACTCGGCGTGGCGTCGGTCGTGG | 127 | 0 | 0 | 0 | 1 | 0 | 0 | 0 | 0.04 |
| ACCACTGACCGTTGACTGTAC | 128 | 0 | 1 | 0 | 0 | 0 | 0.03 | 0 | 0 |
| AACTGGCCTACAAAGTCCCAGT | 129 | 0 | 0 | 1 | 0 | 0 | 0 | 0.04 | 0 |
| TGTCTGAGCGTCGCT | 130 | 0 | 0 | 4 | 0 | 0 | 0 | 0.16 | 0 |
| GCCGGGTACTTTCGTATTTT | 131 | 3 | 3 | 0 | 34 | 0.09 | 0.1 | 0 | 1.39 |
| GCTAAGGAAGTCCTGTGCTCAGTTTT | 132 | 0 | 0 | 1 | 19 | 0 | 0 | 0.04 | 0.78 |
| CCCGGGTTTCGGCACCA | 133 | 0 | 3 | 0 | 1 | 0 | 0.1 | 0 | 0.04 |
| TCGGGCGGGAGTGGTGGCTTT | 134 | 0 | 0 | 0 | 1 | 0 | 0 | 0 | 0.04 |
| TAGAGGCACCGCCTGCCCA | 135 | 0 | 1 | 0 | 0 | 0 | 0.03 | 0 | 0 |

TABLE 1B-continued

List of known and newly identified mature miRNAs including information on frequencies.

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| CGGGGCGCGGCCTCGCTG | 136 | 1 | 0 | 0 | 0 | 0.03 | 0 | 0 | 0 |
| CCCACGGGGTCTCCGGGCGAG | 137 | 1 | 0 | 0 | 0 | 0.03 | 0 | 0 | 0 |
| CCCACGGGAAACAGCA | 138 | 0 | 1 | 0 | 0 | 0 | 0.03 | 0 | 0 |
| CAGCCCGGCCTGGCTCCTCCAT | 139 | 0 | 1 | 0 | 0 | 0 | 0.03 | 0 | 0 |
| CACGGAAGGTGGCCCGG | 140 | 0 | 1 | 0 | 0 | 0 | 0.03 | 0 | 0 |
| CTGTAGGCACCTGAAA | 141 | 1 | 0 | 0 | 148.06 | 0.03 | 0 | 0 | 6.07 |
| CCCCCCACTGCTAAATTTGACTGGCTT | 142 | 18 | 8 | 61 | 22 | 0.52 | 0.27 | 2.39 | 0.9 |
| GCCCGCATCCTCCACCA | 143 | 38 | 61 | 2 | 4 | 1.1 | 2.04 | 0.08 | 0.16 |
| CCCGGCCAACGCACCA | 144 | 28.76 | 36.71 | 4.12 | 4 | 0.83 | 1.23 | 0.16 | 0.16 |
| ATCCCACTCCTGACACCA | 145 | 7 | 13 | 11.31 | 3 | 0.2 | 0.44 | 0.44 | 0.12 |
| CCGGGCGGAAACACCA | 146 | 9 | 9 | 6 | 0 | 0.26 | 0.3 | 0.24 | 0 |
| TGTCAGTTTGTTAATTA | 147 | 1 | 1 | 3 | 16 | 0.03 | 0.03 | 0.12 | 0.66 |
| AGGGTGTGCGTGTTTTT | 148 | 0 | 0 | 0 | 20 | 0 | 0 | 0 | 0.82 |
| TCGATTCCCGGCCCATGCACCA | 149 | 1 | 2 | 10 | 4 | 0.03 | 0.07 | 0.39 | 0.16 |
| GAGAGCGCTCGGTTTTT | 150 | 0 | 0 | 1 | 9 | 0 | 0 | 0.04 | 0.37 |
| TGGTGTGGTCTGTTGTTTT | 151 | 0 | 0 | 0 | 9 | 0 | 0 | 0 | 0.37 |
| TGTGCTCCGGAGTTACCTCGTTT | 152 | 0 | 0 | 0 | 8 | 0 | 0 | 0 | 0.33 |
| TCCCCGACACCTCCACCA | 153 | 2 | 2 | 2 | 1 | 0.06 | 0.07 | 0.08 | 0.04 |
| CTGTAGGCATCATCAAT | 154 | 0 | 0 | 1 | 3.57 | 0 | 0 | 0.04 | 0.15 |
| CCGAGCGTCCAAGCTCTTTCCATTTTT | 155 | 0 | 0 | 0 | 5 | 0 | 0 | 0 | 0.2 |
| TCCCCGCACCTCCACCA | 156 | 0 | 2 | 1 | 1 | 0 | 0.07 | 0.04 | 0.04 |
| TCCCCGGCACTTCCACCA | 157 | 0 | 3 | 0 | 0 | 0 | 0.1 | 0 | 0 |
| TCACCCCATAAACACCA | 158 | 2 | 1 | 0 | 0 | 0.06 | 0.03 | 0 | 0 |
| CTGTAGGCACCATCATAA | 159 | 0 | 0 | 0 | 2.43 | 0 | 0 | 0 | 0.1 |
| CCCACCAGAGTCGCCA | 160 | 1 | 2 | 0 | 0 | 0.03 | 0.07 | 0 | 0 |
| TTCCCCGACGGGGAGCCA | 161 | 1 | 0 | 0 | 1 | 0.03 | 0 | 0 | 0.04 |
| GGCGTGATTCATACCTTTT | 162 | 0 | 0 | 0 | 2 | 0 | 0 | 0 | 0.08 |
| GCGGGCGGACCTTTT | 163 | 1 | 1 | 0 | 0 | 0.03 | 0.03 | 0 | 0 |
| CGGCTCGAAGGACCA | 164 | 0 | 2 | 0 | 0 | 0 | 0.07 | 0 | 0 |
| CCCCGGCCCCGCGTA | 165 | 0 | 2 | 0 | 0 | 0 | 0.07 | 0 | 0 |
| CCCACCTCTGACACCA | 166 | 0 | 1 | 1 | 0 | 0 | 0.03 | 0.04 | 0 |
| CCACGAGGTCGGCCGG | 167 | 0 | 2 | 0 | 0 | 0 | 0.07 | 0 | 0 |
| CAGGATCGGCCCACT | 168 | 2 | 0 | 0 | 0 | 0.06 | 0 | 0 | 0 |
| ATGTGGTGGCTTACTTTT | 169 | 0 | 0 | 0 | 2 | 0 | 0 | 0 | 0.08 |
| ATCCCGGACGAGCCCA | 170 | 0 | 2 | 0 | 0 | 0 | 0.07 | 0 | 0 |
| ATCCCCAGCATCTCCACCA | 171 | 0 | 0 | 2 | 0 | 0 | 0 | 0.08 | 0 |

TABLE 1B-continued

List of known and newly identified mature miRNAs including information on frequencies.

| | | Corrected Counts | | | | Frequencies | | | |
|---|---|---|---|---|---|---|---|---|---|
| Mature miRNA sequence | SEQ ID NO. | Naïve (N) | Memory (M) | Centroblasts (CB) | Ramos (RA) | Naïve (N) | Memory (M) | Centroblasts (CB) | Ramos (RA) |
| AGAAAGGCCGAATTTTA | 172 | 0 | 0 | 1 | 1 | 0 | 0 | 0.04 | 0.04 |
| TGTCAGTTTTTACCCAA | 173 | 0 | 0 | 0 | 1 | 0 | 0 | 0 | 0.04 |
| TGTCAGTTTGAACCCAA | 174 | 0 | 0 | 0 | 1 | 0 | 0 | 0 | 0.04 |
| TGTAGTGTTTCTTACTTTA | 175 | 1 | 0 | 0 | 0 | 0.03 | 0 | 0 | 0 |
| TGGCGAAGGTCGGCCGCG | 176 | 0 | 1 | 0 | 0 | 0 | 0.03 | 0 | 0 |
| TGCAGGGCCGGCGGGAGG | 177 | 0 | 1 | 0 | 0 | 0 | 0.03 | 0 | 0 |
| TCGGGCGGCGGGCGT | 178 | 1 | 0 | 0 | 0 | 0.03 | 0 | 0 | 0 |
| TCGGCTTTCCCTGCTAACTGGGCTTTTT | 179 | 0 | 0 | 0 | 1 | 0 | 0 | 0 | 0.04 |
| TCAGAGCGCGGGCCGACCCC | 180 | 1 | 0 | 0 | 0 | 0.03 | 0 | 0 | 0 |
| TCAACACCCACTCCCTC | 181 | 0 | 1 | 0 | 0 | 0 | 0.03 | 0 | 0 |
| TATCAATGATGCTTCTGAGA | 182 | 0 | 0 | 0 | 1 | 0 | 0 | 0 | 0.04 |
| TAACCCCAGGGTTGGTCA | 183 | 0 | 1 | 0 | 0 | 0 | 0.03 | 0 | 0 |
| GGGGTCCCCGGTAGA | 184 | 0 | 1 | 0 | 0 | 0 | 0.03 | 0 | 0 |
| GGGCGTGGGTGTGATGATTC | 185 | 0 | 0 | 0 | 1 | 0 | 0 | 0 | 0.04 |
| GGGAGGTGAGTAGGTCTG | 186 | 0 | 1 | 0 | 0 | 0 | 0.03 | 0 | 0 |
| GGAGACGTGGCCGAGAG | 187 | 0 | 1 | 0 | 0 | 0 | 0.03 | 0 | 0 |
| GCGGAATACCACGGGGA | 188 | 0 | 1 | 0 | 0 | 0 | 0.03 | 0 | 0 |
| GCAGGCGGGGATTAGCTA | 189 | 1 | 0 | 0 | 0 | 0.03 | 0 | 0 | 0 |
| GCAGCGGAACGTCGGCGCGC | 190 | 0 | 1 | 0 | 0 | 0 | 0.03 | 0 | 0 |
| GACGTCACCCTCCTCA | 191 | 0 | 1 | 0 | 0 | 0 | 0.03 | 0 | 0 |
| CTTGGACTAACCTGGTGTA | 192 | 0 | 0 | 1 | 0 | 0 | 0 | 0.04 | 0 |
| CTGTAGGCCACCATCCA | 193 | 0 | 0 | 0 | 1 | 0 | 0 | 0 | 0.04 |
| CTGTAGGCACCACCA | 194 | 1 | 0 | 0 | 0 | 0.03 | 0 | 0 | 0 |
| CTGGTAGGCACCTGAAA | 195 | 0 | 0 | 0 | 1 | 0 | 0 | 0 | 0.04 |
| CTGATGTTGATGCATATGATGACA | 196 | 0 | 0 | 0 | 1 | 0 | 0 | 0 | 0.04 |
| CGGTGGAACCTGCATTGGTTT | 197 | 0 | 0 | 1 | 0 | 0 | 0 | 0.04 | 0 |
| CGGGGCGGGGCTAGGGT | 198 | 0 | 1 | 0 | 0 | 0 | 0.03 | 0 | 0 |
| CGGGCCGCCCCGCCCACCG | 199 | 0 | 1 | 0 | 0 | 0 | 0.03 | 0 | 0 |
| CGGGCCCCGGGGCTCG | 200 | 0 | 1 | 0 | 0 | 0 | 0.03 | 0 | 0 |
| CGGCCTATCCGGAATGCCCC | 201 | 0 | 1 | 0 | 0 | 0 | 0.03 | 0 | 0 |
| CGGACCTCCCTGGCCC | 202 | 1 | 0 | 0 | 0 | 0.03 | 0 | 0 | 0 |
| CGCGGCCAGTGTCCCCTTGTA | 203 | 1 | 0 | 0 | 0 | 0.03 | 0 | 0 | 0 |
| CGACACACGGCCCGTGGCGC | 204 | 1 | 0 | 0 | 0 | 0.03 | 0 | 0 | 0 |
| CCTCATAAATACCGG | 205 | 0 | 1 | 0 | 0 | 0 | 0.03 | 0 | 0 |
| CCTCACTGGGGGCTCCA | 206 | 1 | 0 | 0 | 0 | 0.03 | 0 | 0 | 0 |
| CCTCACCTGGAGCACCA | 207 | 0 | 0 | 1 | 0 | 0 | 0 | 0.04 | 0 |

TABLE 1B-continued

List of known and newly identified mature miRNAs including information on frequencies.

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| CCGTACTGGCCACCA | 208 | 0 | 1 | 0 | 0 | 0 | 0.03 | 0 | 0 |
| CCGCCGCCCCCCCCT | 209 | 0 | 1 | 0 | 0 | 0 | 0.03 | 0 | 0 |
| CCGCCCCGACCTTAGCTA | 210 | 0 | 1 | 0 | 0 | 0 | 0.03 | 0 | 0 |
| CCCGTCCGCTGCGCCA | 211 | 0 | 1 | 0 | 0 | 0 | 0.03 | 0 | 0 |
| CCCGTCCACTCCGCCA | 212 | 0 | 1 | 0 | 0 | 0 | 0.03 | 0 | 0 |
| CCCCGGCCCATGCACCA | 213 | 0 | 1 | 0 | 0 | 0 | 0.03 | 0 | 0 |
| CCCCGGCATCTCCATCA | 214 | 1 | 0 | 0 | 0 | 0.03 | 0 | 0 | 0 |
| CCCCAGTACCTCCACCA | 215 | 0 | 1 | 0 | 0 | 0 | 0.03 | 0 | 0 |
| CCCAGCGGTGCCTCCA | 216 | 0 | 1 | 0 | 0 | 0 | 0.03 | 0 | 0 |
| CCACGCTCTGCTACCA | 217 | 1 | 0 | 0 | 0 | 0.03 | 0 | 0 | 0 |
| CCACCCTGGAGCCTCCGT | 218 | 0 | 1 | 0 | 0 | 0 | 0.03 | 0 | 0 |
| ATGGTAGGCACCTGAAA | 219 | 0 | 0 | 0 | 1 | 0 | 0 | 0 | 0.04 |
| ATGGGCGGTCCTCGTT | 220 | 0 | 1 | 0 | 0 | 0 | 0.03 | 0 | 0 |
| ATGGCCTGGACCCCACTCCT | 221 | 0 | 0 | 0 | 1 | 0 | 0 | 0 | 0.04 |
| ATGGCCGCATATATTTT | 222 | 0 | 0 | 0 | 1 | 0 | 0 | 0 | 0.04 |
| ATCCTGTTCGTGACGCCA | 223 | 0 | 0 | 1 | 0 | 0 | 0 | 0.04 | 0 |
| ATCCTGCTCACAGCCCCA | 224 | 0 | 1 | 0 | 0 | 0 | 0.03 | 0 | 0 |
| AGCGAGGGTTCCGCCGGCC | 225 | 0 | 0 | 0 | 1 | 0 | 0 | 0 | 0.04 |
| ACTGGGAGGGGAGGAGCCTCGAGG | 226 | 0 | 0 | 0 | 1 | 0 | 0 | 0 | 0.04 |
| ACCCCGAGGGGACGGGCG | 227 | 0 | 1 | 0 | 0 | 0 | 0.03 | 0 | 0 |
| ACAGCGCTGTGTTCCCGT | 228 | 0 | 0 | 1 | 0 | 0 | 0 | 0.04 | 0 |
| ACAAAAAAAAAAGCCCAACCCT | 229 | 0 | 0 | 0 | 1 | 0 | 0 | 0 | 0.04 |
| AACTAAAACCCCTACGCA | 230 | 0 | 0 | 1 | 0 | 0 | 0 | 0.04 | 0 |
| AAAGGAGCCGAATCTTT | 231 | 0 | 0 | 1 | 0 | 0 | 0 | 0.04 | 0 |
| CCCACCCAGGGACGCCA | 232 | 223 | 218 | 6 | 2 | 6.46 | 7.3 | 0.24 | 0.08 |
| TCCCCGGCACCTCCACCA | 233 | 60.47 | 101.82 | 40.28 | 34 | 1.75 | 3.41 | 1.58 | 1.39 |
| ATCCCGGACGAGCCCCCA | 234 | 48 | 60 | 80 | 45 | 1.39 | 2.01 | 3.14 | 1.84 |
| CCCACGTTGGGCGCCA | 235 | 37 | 50 | 1 | 0 | 1.07 | 1.68 | 0.04 | 0 |
| TCGATTCCCGGCCAATGCACCA | 236 | 2.24 | 15.29 | 35.88 | 4 | 0.06 | 0.51 | 1.41 | 0.16 |
| ATCCCACTTCTGACACCA | 237 | 11 | 9 | 26.69 | 14 | 0.32 | 0.3 | 1.05 | 0.57 |
| TCGTAGGCACCTGAAA | 238 | 0 | 0 | 0 | 7.94 | 0 | 0 | 0 | 0.33 |
| TCCCCGTACGGGCCACCA | 239 | 11 | 6 | 3 | 2 | 0.32 | 0.2 | 0.12 | 0.08 |
| TTGACCGCTCTGACCA | 240 | 4 | 9 | 2 | 5 | 0.12 | 0.3 | 0.08 | 0.2 |
| CCCAGCGGGGCCTCCA | 241 | 11 | 8 | 1 | 0 | 0.32 | 0.27 | 0.04 | 0 |
| CAGGAACGGTGCACCA | 242 | 6 | 10 | 2 | 0 | 0.17 | 0.34 | 0.08 | 0 |
| AGTCCCATCTGGGTCGCCA | 243 | 4 | 2 | 3 | 6 | 0.12 | 0.07 | 0.12 | 0.25 |

TABLE 1B-continued

List of known and newly identified mature miRNAs including information on frequencies.

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| CCCCCCACTGCTAAATTTGACTGGA | 244 | 1 | 1 | 6 | 2 | 0.03 | 0.03 | 0.24 | 0.08 |
| GTTTGTTAATTAACCCAA | 245 | 0 | 0 | 1 | 5 | 0 | 0 | 0.04 | 0.2 |
| GTCCCTTCGTGGTCGCCA | 246 | 1 | 2 | 1 | 2 | 0.03 | 0.07 | 0.04 | 0.08 |
| CTGTAGCACCTGAAA | 247 | 0 | 0 | 0 | 6 | 0 | 0 | 0 | 0.25 |
| TCCTCACACGGGGCACCA | 248 | 2 | 1 | 2 | 0 | 0.06 | 0.03 | 0.08 | 0 |
| TAACGGCCGCGGTACCC | 249 | 0 | 3 | 1 | 0 | 0 | 0.1 | 0.04 | 0 |
| GAGGGGGACCAAAAAAAA | 250 | 0 | 0 | 0 | 4 | 0 | 0 | 0 | 0.16 |
| CCCGCATTCTCCACCA | 251 | 3 | 0 | 1 | 0 | 0.09 | 0 | 0.04 | 0 |
| AGGGGGGTAAAAAAAAA | 252 | 0 | 0 | 0 | 4 | 0 | 0 | 0 | 0.16 |
| TCCACCGCTGCCACCA | 253 | 0 | 3 | 0 | 0 | 0 | 0.1 | 0 | 0 |
| GAGCCATGATGATACCACTGAGC | 254 | 0 | 1 | 0 | 2 | 0 | 0.03 | 0 | 0.08 |
| CGTCCATGATGTTCCGCAA | 255 | 1 | 0 | 2 | 0 | 0.03 | 0 | 0.08 | 0 |
| CATCCTCTGCTACCA | 256 | 3 | 0 | 0 | 0 | 0.09 | 0 | 0 | 0 |
| AGAACACTACGAGCCACA | 257 | 3 | 0 | 0 | 0 | 0.09 | 0 | 0 | 0 |
| ACCCCACTTCTGGTACCA | 258 | 0 | 0 | 1 | 2 | 0 | 0 | 0.04 | 0.08 |
| TGTATTGTGAGACATTC | 259 | 0 | 1 | 1 | 0 | 0 | 0.03 | 0.04 | 0 |
| TCTCGGTGGAACCTCCA | 260 | 0 | 0 | 1 | 1 | 0 | 0 | 0.04 | 0.04 |
| TCCCCGGCACCTCCAA | 261 | 0 | 1.01 | 0 | 0 | 0 | 0.03 | 0 | 0 |
| TACCGAGCCTGGTGATAGC | 262 | 0 | 1 | 1 | 0 | 0 | 0.03 | 0.04 | 0 |
| GCAGCGCCAGCCTCCCGCCCTAC | 263 | 2 | 0 | 0 | 0 | 0.06 | 0 | 0 | 0 |
| CCGCCTGGGGAGTAC | 264 | 0 | 2 | 0 | 0 | 0 | 0.07 | 0 | 0 |
| ATCCCCAGCACCTCCACCA | 265 | 0 | 0 | 0 | 2 | 0 | 0 | 0 | 0.08 |
| AGCAGTGATGTCCTGAAAATTCTGAAG | 266 | 0 | 0 | 0 | 2 | 0 | 0 | 0 | 0.08 |
| ACCCCACTATGCTTAGCCCT | 267 | 0 | 0 | 2 | 0 | 0 | 0 | 0.08 | 0 |
| AAAGGACCTGGCGGTGCTTC | 268 | 1 | 0 | 1 | 0 | 0.03 | 0 | 0.04 | 0 |
| TTTGCCACACTGCAACACCTT | 269 | 0 | 0 | 1 | 0 | 0 | 0 | 0.04 | 0 |
| TTCCTTGGATGTCTGAGTGAC | 270 | 0 | 0 | 1 | 0 | 0 | 0 | 0.04 | 0 |
| TTAAACCACCAAGATCGCTGATGCAC | 271 | 0 | 0 | 1 | 0 | 0 | 0 | 0.04 | 0 |
| TGTTCGCCGACCGTTGA | 272 | 0 | 0 | 1 | 0 | 0 | 0 | 0.04 | 0 |
| TGGGGTCTGGGAGGGA | 273 | 0 | 1 | 0 | 0 | 0 | 0.03 | 0 | 0 |
| TGGGAGAGCAGGGTATTGT | 274 | 1 | 0 | 0 | 0 | 0.03 | 0 | 0 | 0 |
| TGCAGATGATGTAAAAGA | 275 | 0 | 0 | 1 | 0 | 0 | 0 | 0.04 | 0 |
| TCGCTATGATGATGGATTCCAAAA | 276 | 0 | 0 | 1 | 0 | 0 | 0 | 0.04 | 0 |
| TCCGAAAGGCCTCCCGCACCG | 277 | 0 | 0 | 1 | 0 | 0 | 0 | 0.04 | 0 |
| TCCCGCACCTCCACCA | 278 | 0 | 0 | 1 | 0 | 0 | 0 | 0.04 | 0 |

TABLE 1B-continued

List of known and newly identified mature miRNAs including information on frequencies.

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| TAGATGAATAGGTAAAGAG | 279 | 0 | 0 | 1 | 0 | 0 | 0 | 0.04 | 0 |
| GTGTATGATGACCTCATGTAGCCTGAAC | 280 | 0 | 0 | 0 | 1 | 0 | 0 | 0 | 0.04 |
| GTGAAGCGTTCCATATTTTT | 281 | 0 | 0 | 1 | 0 | 0 | 0 | 0.04 | 0 |
| GGGGGGGGGTTTGGAA | 282 | 0 | 0 | 0 | 1 | 0 | 0 | 0 | 0.04 |
| GGGGGGAGGGAAGGCAA | 283 | 0 | 0 | 1 | 0 | 0 | 0 | 0.04 | 0 |
| GGGGGCTGGGCTGGGTA | 284 | 0 | 1 | 0 | 0 | 0 | 0.03 | 0 | 0 |
| GGGGCCGCCGCCTGTGT | 285 | 1 | 0 | 0 | 0 | 0.03 | 0 | 0 | 0 |
| GGGAGTCCGCGGCGAGC | 286 | 0 | 0 | 0 | 1 | 0 | 0 | 0 | 0.04 |
| GGGACCTGGGGACCA | 287 | 1 | 0 | 0 | 0 | 0.03 | 0 | 0 | 0 |
| GGCTTGGTCTAGGGGTA | 288 | 0 | 0 | 0 | 1 | 0 | 0 | 0 | 0.04 |
| GGCTGGGACCCTGGACAC | 289 | 0 | 0 | 0 | 1 | 0 | 0 | 0 | 0.04 |
| GGCGACCTGCGACTCCTT | 290 | 0 | 1 | 0 | 0 | 0 | 0.03 | 0 | 0 |
| GGAGGGGGAAACAAA | 291 | 0 | 0 | 0 | 1 | 0 | 0 | 0 | 0.04 |
| GGAGGGGGAAAAAAAAAA | 292 | 0 | 0 | 0 | 1 | 0 | 0 | 0 | 0.04 |
| GGAAGACCTGCACCACTGTC | 293 | 0 | 1 | 0 | 0 | 0 | 0.03 | 0 | 0 |
| GCGGGTGTCAGGCCT | 294 | 1 | 0 | 0 | 0 | 0.03 | 0 | 0 | 0 |
| GCCGGGCGTGGTGGTCTG | 295 | 0 | 1 | 0 | 0 | 0 | 0.03 | 0 | 0 |
| GCCGCCGAGACCCCAGGACCC | 296 | 1 | 0 | 0 | 0 | 0.03 | 0 | 0 | 0 |
| GCAGCCGTGCTTTTA | 297 | 0 | 1 | 0 | 0 | 0 | 0.03 | 0 | 0 |
| GCAAATGATGCCCTCTGATC | 298 | 0 | 0 | 0 | 1 | 0 | 0 | 0 | 0.04 |
| GAGGGGGTCAAAAAA | 299 | 0 | 0 | 0 | 1 | 0 | 0 | 0 | 0.04 |
| CTTGATGATGAGCAGGATCTGAGT | 300 | 0 | 0 | 0 | 1 | 0 | 0 | 0 | 0.04 |
| CTGTAGGCACTGAAA | 301 | 0 | 0 | 0 | 1 | 0 | 0 | 0 | 0.04 |
| CTGTAGGCACCATTAA | 302 | 0 | 0 | 0 | 1 | 0 | 0 | 0 | 0.04 |
| CTGCTTAAGTCCTGACCAG | 303 | 0 | 0 | 1 | 0 | 0 | 0 | 0.04 | 0 |
| CTGAGCACCTTTCCCTTCC | 304 | 0 | 1 | 0 | 0 | 0 | 0.03 | 0 | 0 |
| CTAGCCCCAAACCCA | 305 | 1 | 0 | 0 | 0 | 0.03 | 0 | 0 | 0 |
| CGGTCACACGATTAACCCA | 306 | 0 | 0 | 1 | 0 | 0 | 0 | 0.04 | 0 |
| CGGGGGGAGGAAAAAA | 307 | 0 | 0 | 0 | 1 | 0 | 0 | 0 | 0.04 |
| CGGGGGGAAAAAAAAA | 308 | 0 | 0 | 0 | 1 | 0 | 0 | 0 | 0.04 |
| CGGGGCCGCACGCGC | 309 | 1 | 0 | 0 | 0 | 0.03 | 0 | 0 | 0 |
| CGGGAGTGGGGTGGCGCCCAG | 310 | 1 | 0 | 0 | 0 | 0.03 | 0 | 0 | 0 |
| CGGGAGCCCCGGGTT | 311 | 1 | 0 | 0 | 0 | 0.03 | 0 | 0 | 0 |
| CGGACCTGATAAATTCCCAC | 312 | 0 | 0 | 1 | 0 | 0 | 0 | 0.04 | 0 |
| CGCGGCTCTTGCGGT | 313 | 1 | 0 | 0 | 0 | 0.03 | 0 | 0 | 0 |
| CGCCTGAGTCAGAAC | 314 | 1 | 0 | 0 | 0 | 0.03 | 0 | 0 | 0 |

TABLE 1B-continued

List of known and newly identified mature miRNAs including information on frequencies.

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| CGCCGCCGCCCCCCCC | 315 | 0 | 1 | 0 | 0 | 0 | 0.03 | 0 | 0 |
| CCTTCCTTGGATGTCTGAGTGAG | 316 | 0 | 0 | 1 | 0 | 0 | 0 | 0.04 | 0 |
| CCTCGCTGGGGCCTCCA | 317 | 1 | 0 | 0 | 0 | 0.03 | 0 | 0 | 0 |
| CCTCACAGGGACGCCA | 318 | 1 | 0 | 0 | 0 | 0.03 | 0 | 0 | 0 |
| CCTAGGAGTGCGACAATT | 319 | 0 | 0 | 0 | 1 | 0 | 0 | 0 | 0.04 |
| CCGCTCTGAGACCTA | 320 | 0 | 1 | 0 | 0 | 0 | 0.03 | 0 | 0 |
| CCGCCCGTCACCCTCCTCAAGTA | 321 | 0 | 0 | 1 | 0 | 0 | 0 | 0.04 | 0 |
| CCCGGGCGGCACACCA | 322 | 0 | 1 | 0 | 0 | 0 | 0.03 | 0 | 0 |
| CCCGCGGGCTTGCTGGGCGTCCC | 323 | 0 | 1 | 0 | 0 | 0 | 0.03 | 0 | 0 |
| CCCCTGCGATTTCCCCA | 324 | 0 | 1 | 0 | 0 | 0 | 0.03 | 0 | 0 |
| CCCCGGCATCTCCACTA | 325 | 1 | 0 | 0 | 0 | 0.03 | 0 | 0 | 0 |
| CCCCAGTGAGTGCCCTCTTCC | 326 | 0 | 1 | 0 | 0 | 0 | 0.03 | 0 | 0 |
| CCCAGAGACGCCGTCCTCGA | 327 | 1 | 0 | 0 | 0 | 0.03 | 0 | 0 | 0 |
| CCCACCGAGGATGCCA | 328 | 1 | 0 | 0 | 0 | 0.03 | 0 | 0 | 0 |
| CCATCACTACCCACCA | 329 | 0 | 1 | 0 | 0 | 0 | 0.03 | 0 | 0 |
| CCACTCCAGCCTAGCCCC | 330 | 0 | 1 | 0 | 0 | 0 | 0.03 | 0 | 0 |
| CAGTACAGGCACACCTC | 331 | 0 | 1 | 0 | 0 | 0 | 0.03 | 0 | 0 |
| CACGTCGGGGTCCCCA | 332 | 1 | 0 | 0 | 0 | 0.03 | 0 | 0 | 0 |
| CACGATTAACCCAAGTC | 333 | 0 | 0 | 1 | 0 | 0 | 0 | 0.04 | 0 |
| CACCACACCCGGGCCA | 334 | 1 | 0 | 0 | 0 | 0.03 | 0 | 0 | 0 |
| CAACACAGGCATGCT | 335 | 0 | 1 | 0 | 0 | 0 | 0.03 | 0 | 0 |
| ATAGGGTTTACGACCTCGATGTTGGATCA | 336 | 0 | 0 | 1 | 0 | 0 | 0 | 0.04 | 0 |
| ATACCATGATGAACAATAGCTGAGA | 337 | 0 | 0 | 0 | 1 | 0 | 0 | 0 | 0.04 |
| AGGGTTCAGCTGTCTC | 338 | 1 | 0 | 0 | 0 | 0.03 | 0 | 0 | 0 |
| AGGCTGTGATGGACCTGGCTGAGCCTG | 339 | 0 | 0 | 0 | 1 | 0 | 0 | 0 | 0.04 |
| AGAGAGTAGGGGGAGGT | 340 | 0 | 1 | 0 | 0 | 0 | 0.03 | 0 | 0 |
| ACTGTCCCTGTCTACTA | 341 | 0 | 0 | 0 | 1 | 0 | 0 | 0 | 0.04 |
| ACCGCATCTGGCCTATTTTT | 342 | 0 | 0 | 0 | 1 | 0 | 0 | 0 | 0.04 |
| ACCAGACCTCCTGTGCGAAG | 343 | 0 | 0 | 0 | 1 | 0 | 0 | 0 | 0.04 |
| ACAGCCCGGATCCCAGCCCACTTA | 344 | 0 | 0 | 0 | 1 | 0 | 0 | 0 | 0.04 |
| ACACTGAGCCACAACCCA | 345 | 0 | 0 | 1 | 0 | 0 | 0 | 0.04 | 0 |
| AAGGGCTTGGCTTAATTA | 346 | 0 | 0 | 1 | 0 | 0 | 0 | 0.04 | 0 |
| AACCCGGAAGGCGGAGGTTGCGG | 347 | 0 | 0 | 0 | 1 | 0 | 0 | 0 | 0.04 |
| AACCCCACACCAACC | 348 | 0 | 0 | 0 | 1 | 0 | 0 | 0 | 0.04 |

TABLE 1B-continued

List of known and newly identified mature miRNAs including information on frequencies.

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| AACAAGCTTCTTTGACGTCCCATCCAC | 349 | 0 | 0 | 0 | 1 | 0 | 0 | 0 | 0.04 |
| TCCCCGGCATCTCCACCA | 350 | 116.53 | 275.18 | 104.72 | 59 | 3.38 | 9.22 | 4.11 | 2.42 |
| CTGATTGCTCCTGTCTGATT | 351 | 0 | 0 | 6 | 1 | 0 | 0 | 0.24 | 0.04 |
| TCTAGAGGAGCCTGTTCTGTA | 352 | 0 | 1 | 3 | 0 | 0 | 0.03 | 0.12 | 0 |
| TCGATTCCCGGTCAGGGAACCA | 353 | 0 | 0 | 0 | 4 | 0 | 0 | 0 | 0.16 |
| ATAGGTTTGGTCCTAGCCTTTCT | 354 | 0 | 0 | 3 | 1 | 0 | 0 | 0.12 | 0.04 |
| CGTTCGCGCTTTCCCCTG | 355 | 0 | 1 | 2 | 0 | 0 | 0.03 | 0.08 | 0 |
| TAAGTGTTTGTGGGTTA | 356 | 1 | 1 | 0 | 0 | 0.03 | 0.03 | 0 | 0 |
| GGCGGCGGGAGACCCA | 357 | 1 | 1 | 0 | 0 | 0.03 | 0.03 | 0 | 0 |
| CCCCGGCAGGTTTGA | 358 | 0 | 2 | 0 | 0 | 0 | 0.07 | 0 | 0 |
| TGCCGTGATCGTATAGTGGTTA | 359 | 0 | 0 | 1 | 0 | 0 | 0 | 0.04 | 0 |
| TCAGACTACTCTCCTCCGCCCATT | 360 | 0 | 0 | 1 | 0 | 0 | 0 | 0.04 | 0 |
| GGACACAGAGGCTTCG | 361 | 0 | 1 | 0 | 0 | 0 | 0.03 | 0 | 0 |
| CTGACAGCCGGGGTTTTGGA | 362 | 0 | 0 | 0 | 1 | 0 | 0 | 0 | 0.04 |
| CGGCGGGGCCTGGAGTCTG | 363 | 1 | 0 | 0 | 0 | 0.03 | 0 | 0 | 0 |
| CCTGGCTCGCTGCGCCA | 364 | 1 | 0 | 0 | 0 | 0.03 | 0 | 0 | 0 |
| CCGCCCCACCCCGCGCGC | 365 | 0 | 1 | 0 | 0 | 0 | 0.03 | 0 | 0 |
| CCCGAACGCTGCCAACCC | 366 | 0 | 1 | 0 | 0 | 0 | 0.03 | 0 | 0 |
| AGACCCGCGGGCGCTCTCCAGTC | 367 | 0 | 0 | 1 | 0 | 0 | 0 | 0.04 | 0 |
| CCCCCACAACCGCGCTTGACTAGC | 368 | 12 | 11 | 7 | 9 | 0.35 | 0.37 | 0.27 | 0.37 |
| CCCTGCTCGCTGCGCCA | 369 | 7 | 20 | 5 | 1 | 0.2 | 0.67 | 0.2 | 0.04 |
| CTCCCACTGCTTCACTTGACTAGC | 370 | 2 | 2 | 18 | 9 | 0.06 | 0.07 | 0.71 | 0.37 |
| CCCATCCTCGTCGCCA | 371 | 16 | 11 | 1 | 1 | 0.46 | 0.37 | 0.04 | 0.04 |
| TCACGTCGGGGTCACCA | 372 | 16 | 4 | 5 | 1 | 0.46 | 0.13 | 0.2 | 0.04 |
| TCCCTGGTGGTCTAGTGGTTAGGATTCG | 373 | 0 | 1 | 10 | 6 | 0 | 0.03 | 0.39 | 0.25 |
| GGTAGCGTGGCCGAG | 374 | 10 | 6 | 0 | 0 | 0.29 | 0.2 | 0 | 0 |
| TCCTGCCGCGGTCGCCA | 375 | 6 | 8 | 0 | 1 | 0.17 | 0.27 | 0 | 0.04 |
| GGAGAGAACGCGGTCTGAGTGGT | 376 | 3 | 7 | 1 | 0 | 0.09 | 0.23 | 0.04 | 0 |
| TCGGGTGCGAGAGGTCCCGGGT | 377 | 0 | 0 | 0 | 10 | 0 | 0 | 0 | 0.41 |
| GGCTGGTCCGATGGTAGTGGGTT | 378 | 4 | 3 | 3 | 0 | 0.12 | 0.1 | 0.12 | 0 |
| CGGAAGCGTGCTGGGCCC | 379 | 1 | 5 | 0 | 4 | 0.03 | 0.17 | 0 | 0.16 |
| CCCGGGCGGCGCACCA | 380 | 5 | 4 | 0 | 0 | 0.14 | 0.13 | 0 | 0 |
| GCGGGTGATGCGAACTGGAGTCTGAGC | 381 | 0 | 0 | 6 | 1 | 0 | 0 | 0.24 | 0.04 |
| GACGAGGTGGCCGAGTGG | 382 | 2 | 3 | 2 | 0 | 0.06 | 0.1 | 0.08 | 0 |
| GGGGGTGTAGCTCAG | 383 | 4 | 2 | 0 | 0 | 0.12 | 0.07 | 0 | 0 |

TABLE 1B-continued

List of known and newly identified mature miRNAs including information on frequencies.

| Mature miRNA sequence | SEQ ID NO. | Corrected Counts | | | | Frequencies | | | |
|---|---|---|---|---|---|---|---|---|---|
| | | Naive (N) | Memory (M) | Centroblasts (CB) | Ramos (RA) | Naive (N) | Memory (M) | Centroblasts (CB) | Ramos (RA) |
| CTCCTGGCTGGCTCGCCA | 384 | 0 | 0 | 3 | 3 | 0 | 0 | 0.12 | 0.12 |
| CGGGAGGCCCGGGTT | 385 | 3 | 3 | 0 | 0 | 0.09 | 0.1 | 0 | 0 |
| GGCTGGTCCGAGTGCAGTGGTGTTTA | 386 | 0 | 1 | 4 | 0 | 0 | 0.03 | 0.16 | 0 |
| CTGCTGTGATGACATTC | 387 | 1 | 2 | 2 | 0 | 0.03 | 0.07 | 0.08 | 0 |
| TGTCACGCGGGAGACC | 388 | 0.5 | 0 | 1 | 1.4 | 0.01 | 0 | 0.04 | 0.06 |
| TCCTCGTTAGTATAGTGGTGAGTATCCC | 389 | 0 | 1 | 3 | 0 | 0 | 0.03 | 0.12 | 0 |
| GGCCGGTTAGCTCAG | 390 | 2 | 2 | 0 | 0 | 0.06 | 0.07 | 0 | 0 |
| GCATTGGTGGTTCAGTGGTAGA | 391 | 0 | 0 | 3 | 1 | 0 | 0 | 0.12 | 0.04 |
| CTGTCACGCGGGAGA | 392 | 0.5 | 0 | 0 | 2.6 | 0.01 | 0 | 0 | 0.11 |
| CTACGGGATGATTTT | 393 | 3 | 1 | 0 | 0 | 0.09 | 0.03 | 0 | 0 |
| CCAGGGGCTGAGGGCA | 394 | 1 | 3 | 0 | 0 | 0.03 | 0.1 | 0 | 0 |
| TTCTCACTACTGCACTTGACTA | 395 | 0 | 0 | 2 | 1 | 0 | 0 | 0.08 | 0.04 |
| TGGTTATCACGTTCGCC | 396 | 0 | 2 | 0 | 1 | 0 | 0.07 | 0 | 0.04 |
| TAGGGGTATGATTCTCGCT | 397 | 1 | 0 | 0 | 2 | 0.03 | 0 | 0 | 0.08 |
| CCACGAGGAAGAGAGGTAGC | 398 | 2 | 1 | 0 | 0 | 0.06 | 0.03 | 0 | 0 |
| GTCAGGATGGCCGAGCGGTCT | 399 | 0 | 1 | 1 | 0 | 0 | 0.03 | 0.04 | 0 |
| GGGGATGTAGCTCAG | 400 | 1 | 1 | 0 | 0 | 0.03 | 0.03 | 0 | 0 |
| GCAGCGATGGCCGAG | 401 | 0 | 2 | 0 | 0 | 0 | 0.07 | 0 | 0 |

Three hundred and thirty five sequences aligned to genomic regions which did not fulfill the criteria for miRNA precursors (FIG. 11). About 30% of these non-miRNA sequences were annotated and may represent degradation products originating from other RNA species (FIG. 11 and Table 2).

TABLE 2

Characterization of short-RNA libraries. Number of non-redundant short-RNAs cloned in each library (naive, memory, and centroblast B cells, and Ramos cell line) and overall (Total).

| RNA species | Naive | Memory | Centroblasts | Ramos | Total |
|---|---|---|---|---|---|
| Total (non redundant) | 683 | 710 | 744 | 765 | 2115 |
| miRNA | 498 | 485 | 584 | 590 | 1453 |
| miRNA other* | 5 | 3 | 7 | 4 | 19 |
| tRNA | 27 | 33 | 32 | 29 | 108 |
| rRNA | 61 | 99 | 34 | 16 | 174 |
| mRNA | 76 | 72 | 25 | 34 | 176 |
| yRNA | 11 | 11 | 31 | 21 | 53 |
| piRNA | 46 | 54 | 70 | 62 | 148 |
| Repeats | 1 | 1 | 0 | 1 | 2 |
| Mitochondrial genome | 12 | 36 | 54 | 11 | 101 |
| Human viruses | 1 | 4 | 0 | 0 | 5 |
| E. Coli | 5 | 4 | 0 | 0 | 7 |
| Not Annotated | 66 | 64 | 74 | 113 | 262 |

*miRNA other includes fragments of miRNA precursors, not mature

Each short-RNA is annotated according to the listed RNA species. Results shown in Table 2 refer only to short-RNAs with good-quality matches to the human genome. The same short-RNA may match to multiple databases and therefore the overall sum does not correspond to the total number of short-RNAs. The databases used in the analysis depicted in Table 2 is detailed in the Supplementary Methods section.

The remaining (236 sequences), however, mapped to genomic regions that lack annotations and may therefore represent a part of the transcriptome whose functions are unknown (Table 3A-3B and Table 4A-4B).

TABLE 3A

List of short-RNA lacking genomic locations with
appropriate RNA secondary structures to be defined miRNAs.

| ID | SEQ ID NO: | Short-RNA sequence | Annotations |
|---|---|---|---|
| CU-5016 | 402 | AATGACACGATCACTCCCGTTGAG | Mature:hsa-miR-425:MIMAT0003393 |
| CU-5019 | 403 | GGAGGGGGGTAAAAAAAA | NEW |
| CU-5020 | 404 | CCCCGGCATCTCCACC | NEW |
| CU-5004 | 405 | GAAGCGGGTGCTCTTATTTT | NEW |
| CU-5021 | 406 | ACCGGGCGGAAACACCA | NEW |
| CU-5022 | 407 | TCCCGGGTTCAAATCCCGGACGAGCCCCCA | NEW |
| CU-5008 | 408 | GTGTAAGCAGGGTCGTTTT | NEW |
| CU-6003 | 409 | ATCCCACCGCTGCTACCA | NEW |
| CU-5023 | 410 | GGGAAGGTGACCTGAC | NEW |
| CU-5007 | 411 | CTCCCGCCTTTTTTCCC | NEW |
| CU-5024 | 412 | CGGAGCAAGAGCGT | NEW |
| CU-5025 | 413 | CCCCGTACTGGCCACCA | NEW |
| CU-5026 | 414 | CCCCCGGCACCATCAATA | NEW |
| CU-5027 | 415 | CAGCCTAGCCCCTACCC | NEW |
| CU-5005 | 416 | CAGAAGGTCTCACTTTT | NEW |
| CU-5006 | 417 | AGTATTCTCTGTGGCTTT | NEW |
| CU-5028 | 418 | TGGAGTGACTATATGGATGCCCCC | NEW |
| CU-5029 | 419 | TCTGATAGCTTACTTT | NEW |
| CU-5030 | 420 | TCGAGCCCCAGTGGAACCAC | NEW |
| CU-5031 | 421 | TCGAATCCTGTTCGTGACGCCA | NEW |
| CU-5032 | 422 | TCCTCCCCACACTCATCGCCCTTACCA | NEW |
| CU-5033 | 423 | TATACTACAAGGACACCA | NEW |
| CU-5034 | 424 | TAGTGGGTGAAAAAAAAAAA | NEW |
| CU-5035 | 425 | TACCACACATTCGAAGAACCCGTA | NEW |
| CU-5036 | 426 | TACAAAACCCACCCCATTCCTCCCCA | NEW |
| CU-5037 | 427 | GCCCTCCTAATGACCTCC | NEW |
| CU-5038 | 428 | CTTCCCTCTACACTTATCATC | NEW |
| CU-5039 | 429 | CGGGCGGCCTGCGCTCTCA | NEW |
| CU-5040 | 430 | CCCGAGGCCGTGTGCAAATGCAT | NEW |
| CU-5041 | 431 | CCCCCAGTACCTCCACCA | NEW |
| CU-5042 | 432 | CCCCCACTGCTAAACTTGACTGGCTTT | NEW |
| CU-5043 | 433 | COCACTOCACOTTACTACCA | NEW |
| CU-5044 | 434 | CCCAAGAACAGGGTGACCA | NEW |
| CU-5045 | 435 | CCAGTCGCGGCCAAATCA | NEW |
| CU-5046 | 436 | CCAGCTTCACCAAGGTATTGGTTA | NEW |
| CU-5047 | 437 | CCAGAAAAAACAGGCCTC | NEW |
| CU-5048 | 438 | CATCATAATCGGAGGCTTTGGCAAC | NEW |

TABLE 3A-continued

List of short-RNA lacking genomic locations with
appropriate RNA secondary structures to be defined miRNAs.

| ID | SEQ ID NO: | Short-RNA sequence | Annotations |
| --- | --- | --- | --- |
| CU-5049 | 439 | CAGCAGGGGTAATAAGTGAAATCAAA | NEW |
| CU-5050 | 440 | CAATGGTGCAGCCGCTATTAAAGGTTCA | NEW |
| CU-5051 | 441 | CAACTCCTACATACTTCCCCC | NEW |
| CU-5052 | 442 | ATTCAAAAAAGAGTACCA | NEW |
| CU-5053 | 443 | ATGCATCTCATATGCGAATAGGAATGC | NEW |
| CU-5054 | 444 | ATCCCACTTCTGTACCA | NEW |
| CU-5055 | 445 | ATAACACTAGAAAGTTGGGGCAGATTGC | NEW |
| CU-5056 | 446 | ACGTGGGCACATTACCCGTCTGACCTGA | NEW |
| CU-5057 | 447 | ACCCCTTATTAACCCA | NEW |
| CU-5058 | 448 | ACAAGGCACACCTACACCCCTTATCCC | NEW |
| CU-5059 | 449 | AAAAGACACCCCCCCACCA | NEW |
| CU-5060 | 450 | AAAACCCCTACGCATTTATAT | NEW |
| CU-5061 | 451 | AAAAAGACACCCCCCACCA | NEW |
| CU-5003 | 452 | ACCCCACTCCTGGTACCA | refseqGeneIntron-annotate |
| CU-5009 | 453 | TGCCCCCATGTCTAACAACATGGCTA | refseqGeneIntron-annotate;rnaGene-annotate |
| CU-5013 | 454 | GGCCGGTGATGAGAACT | mRNAall-annotate;refseqGeneIntron-annotate; wgRNA-annotate;snoRNA-annotate |
| CU-5062 | 455 | CCCCGCCTGTTTACC | refseqGeneIntron-annotate |
| CU-5063 | 456 | CCCACTTCTGACACCA | computGene-annotate;refseqGeneIntron-annotate; exEID-annotate |
| CU-5064 | 457 | CACCACCTCTTGCTCAGCC | mRNA-annotate;refseqGeneIntron-annotate |
| CU-5014 | 458 | CTGGAAAGTGCACTTGGACGAACA | refseqGeneIntron-annotate |
| CU-5065 | 459 | TGACCGCTCTGACCAC | refseqGeneIntron-annotate |
| CU-5066 | 460 | TGAAGTCCCTTTGCTTTGTT | refseqGeneIntron-annotate |
| CU-5067 | 461 | TGAACACACAATAGCTAAGACCC | mRNA-annotate;refseqGeneIntron-annotate |
| CU-5068 | 462 | TCGCCTTACCCCCCACTA | refseqGeneIntron-annotate |
| CU-5069 | 463 | TCGATAAACCCCGATCAACCT | mRNA-annotate;refseqGeneIntron-annotate |
| CU-5070 | 464 | TCCCCGTCACCTCCACCA | refseqGeneIntron-annotate |
| CU-5071 | 465 | TCCCCGGCACTCCACCA | refseqGeneIntron-annotate |
| CU-5072 | 466 | TCCCCCCGCTGCCACCA | refseqGeneIntron-annotate |
| CU-5073 | 467 | TCCCCCCATCTCCACCA | refseqGeneIntron-annotate |
| CU-5074 | 468 | TACACACCGCCCGTCACCC | mRNA-annotate;refseqGeneIntron-annotate |
| CU-5075 | 469 | GGCCGGTGATGAGAACTTCTCCC | mRNAall-annotate;refseqGeneIntron-annotate; wgRNA-annotate;snoRNA-annotate |
| CU-5076 | 470 | GCTTAGCCTAGCCACACCCCCACG | mRNA-annotate;refseqGeneIntron-annotate |
| CU-5077 | 471 | GCTCGCCAGAACACTACGA | mRNA-annotate;refseqGeneIntron-annotate |
| CU-5078 | 472 | GCCGGGGGGCGGGCGCA | refseqGeneIntron-annotate |
| CU-5079 | 473 | GAACCGGGCGGGAACACCA | refseqGeneIntron-annotate |
| CU-5080 | 474 | CGCCGCAGTACTGATCATTC | refseqGeneIntron-annotate |

TABLE 3A-continued

List of short-RNA lacking genomic locations with
appropriate RNA secondary structures to be defined miRNAs.

| ID | SEQ ID NO: | Short-RNA sequence | Annotations |
|---|---|---|---|
| CU-5081 | 475 | CCGCACCAATAGGATCCTCC | refseqGeneIntron-annotate |
| CU-5082 | 476 | CCCGGCCGACGCACCA | refseqGeneIntron-annotate |
| CU-5083 | 477 | CCACCCCATCATACTCTTTC | refseqGeneIntron-annotate |
| CU-5084 | 478 | CACCCCCCAGCTCCTCCTTT | refseqGeneIntron-annotate |
| CU-5085 | 479 | ATAAGTAACATGAAAACATTCTCCTC | refseqGeneIntron-annotate |
| CU-5086 | 480 | ACTGCTCGCCAGAACAC | mRNA-annotate;refseqGeneIntron-annotate |
| CU-5087 | 481 | ACCCTGGTGTGGGATCTGCCCGATC | refseqGeneIntron-annotate |
| CU-5088 | 482 | AACCTCACCACCTCTTTCT | refseqGeneIntron-annotate |
| CU-5089 | 483 | AAAAGACACCCCCCACACCA | refseqGeneIntron-annotate |
| CU-5011 | 484 | GCTAAACCTAGCCCCAAACCC | piRNA-annotate |
| CU-5010 | 485 | GGCCGTGATCGTATA | piRNA-annotate |
| CU-5090 | 486 | TGGGATGCGAGAGGTCCCGGGT | rnaGene-annotate |
| CU-5091 | 487 | CTGAACTCCTCACACCC | piRNA-annotate |
| CU-5092 | 488 | ATTAATCCCTGGCCCAACCCG | computGene-annotate |
| CU-5093 | 489 | AGCCCCAAACCCACTCCAC | piRNA-annotate |
| CU-5094 | 490 | CGCGACCTCAGATCAGAC | rRNA-eliminate;piRNA-annotate;refseqGeneIntron-annotate |
| CU-5015 | 491 | TCAAGTGATGTCATCTTACTACTGAGA | mRNAall-annotate;snoRNA-annotate;snoRNA-eliminate;wgRNA-annotate;rnaGene-annotate |
| CU-5095 | 492 | TTGGGTGCGAGAGGTCCCGGGT | tRNAcomputational-annotate;tRNA-eliminate;HStRNA-eliminate;rnaGene-annotate |
| CU-5096 | 493 | TCTCGGTGGGACCTCCA | refseqGeneExon-eliminate |
| CU-5097 | 494 | CCGCCCCCGTTCCCCC | rRNA-eliminate |
| CU-5098 | 495 | CCCACTGCTAAATTTGACTGGCTT | mRNAall-annotate;yRNA-eliminate;refseqGeneIntron-annotate;rnaGene-annotate |
| CU-5099 | 496 | ACAGACCAAGAGCCTTC | tRNA-eliminate;rnaGene-annotate |
| CU-5100 | 497 | TGTAGTAGTCAATTAATGGATATTA | refseqGeneExon-eliminate |
| cu-5101 | 498 | TGGTTATCACGTTCGCCTCACACGCGA | tRNAcomputational-annotate;tRNA-eliminate;HStRNA-eliminate;rnaGene-annotate |
| CU-5102 | 499 | TGGGAATACCGGGTG | rRNA-eliminate;rnaGene-annotate;piRNA-annotate;refseqGeneIntron-annotate |
| CU-5103 | 500 | TGGCGGCCAAGCGTTCATAGCGACGTC | rRNA-eliminate;refseqGeneIntron-annotate;rnaGene-annotate |
| CU-5104 | 501 | TCGTCATCCAGCTAAGGGCTCAGA | mRNAall-annotate;refseqGeneExon-eliminate;exEID-annotate |
| CU-5105 | 502 | TCGCCTGCCACGCGGGAGGCCCGGGT | rnaGene-annotate;tRNAcomputational-annotate;tRNA-eliminate;refseqGeneIntron-annotate;mRNA-annotate;HStRNA-eliminate |
| CU-5106 | 503 | TCCCACTGCTTCACTTGA | yRNA-eliminate;refseqGeneIntron-annotate;rnaGene-annotate |
| CU-5107 | 504 | GTTTAGACGGGCTCACATCACCCCA | tRNA-eliminate;pi RNA-annotate;refseqGeneIntron-annotate |

TABLE 3A-continued

List of short-RNA lacking genomic locations with
appropriate RNA secondary structures to be defined miRNAs.

| ID | SEQ ID NO: | Short-RNA sequence | Annotations |
|---|---|---|---|
| CU-5108 | 505 | GCTAACTCATGCCCCCATGTC | tRNA-eliminate;refseqGeneIntron-annotate;rnaGene-annotate |
| CU-5109 | 506 | GACTGTGGTGGTTGAATATA | mRNAall-annotate;computGene-annotate; refseqGeneExon-eliminate;exEID-annotate |
| CU-5110 | 507 | CGCGACCTCAGATCAGACGTGGCGACC | rRNA-eliminate;piRNA-annotate;refseqGeneIntron-annotate |
| CU-5111 | 508 | CGCCGCCGCCCCCCC | mRNAall-annotate;refseqGeneExon-eliminate; refseqGeneIntron-annotate;exEID-annotate |
| CU-5112 | 509 | CGCCCGACTACCACCACATCCA | mRNAall-annotate;computGene-annotate; refseqGeneExon-eliminate;exEID-annotate |
| CU-5113 | 510 | CCCCCCTCCACGCGCCC | rRNA-eliminate;refseqGeneIntron-annotate |
| CU-5114 | 511 | CCCCACCCCGCGCCCTC | rRNA-eliminate;refseqGeneIntron-annotate |
| CU-5115 | 512 | CAGAGTGTAGCTTAACACAAAGCACCCAA | tRNA-eliminate;piRNA-annotate;rnaGene-annotate |
| CU-5116 | 513 | CAATCTTGGCATGTTGGTCTGGTCACCCA | mRNAall-annotate;refseqGeneExon-eliminate;exEID-annotate |
| CU-5117 | 514 | CAAAGCATCGCGAAGGCCC | mRNAall-annotate;rRNA-eliminate;piRNA-annotate; rnaGene-annotate |
| CU-5118 | 515 | AACACCCTGATTGCTCCTGTCTGAT | mRNAall-annotate;exEID-annotate;snoRNA-annotate; refseqGeneExon-eliminate;rnaGene-annotate; snoRNA-eliminate;wgRNA-annotate |
| CU-5119 | 516 | AAAAAGGGCCTAAAGAAGATGCA | mRNAall-annotate;computGene-annotate;refseqGene-Exon-eliminate;refseqGeneIntron-annotate;exEID-annotate |

TABLE 3B

List of short-RNA lacking genomic locations with appropriate RNA secondary structures to be defined miRNAs including information on frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 525 | AATGACACGATCACTCCCGTTGAG | 0 | 0 | 7 | 0 | 0 | 0 | 3.98 | 0 |
| 526 | GGAGGGGGGTAAAAAAA | 0 | 0 | 1 | 0 | 0 | 0 | 0.57 | 0 |
| 527 | CCCCGGCATCTCCACC | 1 | 0 | 0 | 0 | 1.72 | 0 | 0 | 0 |
| 528 | GAAGCGGGTGCTCTTATTTT | 5 | 23 | 25 | 224 | 8.62 | 20.35 | 14.2 | 65.31 |
| 529 | ACCGGGCGGAAACACCA | 9 | 14 | 60 | 20 | 15.52 | 12.39 | 34.09 | 5.83 |
| 530 | TCCCGGGTTCAAATCCCGGACGAGCCCCA | 0 | 0 | 4 | 37 | 0 | 0 | 2.27 | 10.79 |
| 531 | GTGTAAGCAGGGTCGTTTT | 0 | 0 | 0 | 7 | 0 | 0 | 0 | 2.04 |
| 532 | ATCCCACCGCTGCTACCA | 0 | 1 | 0 | 2 | 0 | 0.88 | 0 | 0.58 |
| 533 | GGGAAGGTGACCTGAC | 2 | 0 | 0 | 0 | 3.45 | 0 | 0 | 0 |
| 534 | CTCCCGCCTTTTTTCCC | 0 | 2 | 0 | 0 | 0 | 1.77 | 0 | 0 |
| 535 | CGGAGCAAGAGCGT | 2 | 0 | 0 | 0 | 3.45 | 0 | 0 | 0 |
| 536 | CCCCGTACTGGCCACCA | 2 | 0 | 0 | 0 | 3.45 | 0 | 0 | 0 |
| 537 | CCCCCGGCACCATCAATA | 0 | 0 | 1 | 1 | 0 | 0 | 0.57 | 0.29 |

TABLE 3B-continued

List of short-RNA lacking genomic locations with appropriate RNA secondary structures to be defined miRNAs including information on frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 538 | CAGCCTAGCCCCTACCC | 0 | 2 | 0 | 0 | 0 | 1.77 | 0 | 0 |
| 539 | CAGAAGGTCTCACTTTT | 0 | 1 | 0 | 1 | 0 | 0.88 | 0 | 0.29 |
| 540 | AGTATTCTCTGTGGCTTT | 0 | 0 | 0 | 2 | 0 | 0 | 0 | 0.58 |
| 541 | TGGAGTGACTATATGGATGCCCCC | 0 | 0 | 1 | 0 | 0 | 0 | 0.57 | 0 |
| 542 | TCTGATAGCTTACTTT | 0 | 1 | 0 | 0 | 0 | 0.88 | 0 | 0 |
| 543 | TCGAGCCCCAGTGGAACCAC | 0 | 0 | 1 | 0 | 0 | 0 | 0.57 | 0 |
| 544 | TCGAATCCTGTTCGTGACGCCA | 0 | 0 | 0 | 1 | 0 | 0 | 0 | 0.29 |
| 545 | TCCTCCCCACACTCATCGCCCTTACCA | 0 | 0 | 1 | 0 | 0 | 0 | 0.57 | 0 |
| 546 | TATACTACAAGGACACCA | 0 | 0 | 0 | 1 | 0 | 0 | 0 | 0.29 |
| 547 | TAGTGGGTGAAAAAAAAAAA | 0 | 0 | 0 | 1 | 0 | 0 | 0 | 0.29 |
| 548 | TACCACACATTCGAAGAACCCGTA | 0 | 0 | 1 | 0 | 0 | 0 | 0.57 | 0 |
| 549 | TACAAAACCCACCCCATTCCTCCCCA | 0 | 1 | 0 | 0 | 0 | 0.88 | 0 | 0 |
| 550 | GCCCTCCTAATGACCTCC | 0 | 0 | 1 | 0 | 0 | 0 | 0.57 | 0 |
| 551 | CTTCCCTCTACACTTATCATC | 0 | 0 | 1 | 0 | 0 | 0 | 0.57 | 0 |
| 552 | CGGGCGGCCTGCGCTCTCA | 1 | 0 | 0 | 0 | 1.72 | 0 | 0 | 0 |
| 553 | CCCGAGGCCGTGTGCAAATGCAT | 0 | 0 | 1 | 0 | 0 | 0 | 0.57 | 0 |
| 554 | CCCCCAGTACCTCCACCA | 0 | 1 | 0 | 0 | 0 | 0.88 | 0 | 0 |
| 555 | CCCCCACTGCTAAACTTGACTGGCTTT | 0 | 0 | 1 | 0 | 0 | 0 | 0.57 | 0 |
| 556 | CCCACTCCACCTTACTACCA | 0 | 0 | 0 | 1 | 0 | 0 | 0 | 0.29 |
| 557 | CCCAAGAACAGGGTGACCA | 0 | 0 | 0 | 1 | 0 | 0 | 0 | 0.29 |
| 558 | CCAGTCGCGGCCAAATCA | 0 | 1 | 0 | 0 | 0 | 0.88 | 0 | 0 |
| 559 | CCAGCTTCACCAAGGTATTGGTTA | 0 | 0 | 1 | 0 | 0 | 0 | 0.57 | 0 |
| 560 | CCAGAAAAAACAGGCCTC | 0 | 0 | 0 | 1 | 0 | 0 | 0 | 0.29 |
| 561 | CATCATAATCGGAGGCTTTGGCAAC | 0 | 0 | 1 | 0 | 0 | 0 | 0.57 | 0 |
| 562 | CAGCAGGGGTAATAAGTGAAATCAAA | 0 | 0 | 1 | 0 | 0 | 0 | 0.57 | 0 |
| 563 | CAATGGTGCAGCCGCTATTAAAGGTTCA | 0 | 0 | 0 | 1 | 0 | 0 | 0 | 0.29 |
| 564 | CAACTCCTACATACTTCCCCC | 1 | 0 | 0 | 0 | 1.72 | 0 | 0 | 0 |
| 565 | ATTCAAAAAGAGTACCA | 0 | 0 | 1 | 0 | 0 | 0 | 0.57 | 0 |
| 566 | ATGCATCTCATATGCGAATAGGAATGC | 0 | 0 | 1 | 0 | 0 | 0 | 0.57 | 0 |
| 567 | ATCCCACTTCTGTACCA | 0 | 1 | 0 | 0 | 0 | 0.88 | 0 | 0 |

TABLE 3B-continued

List of short-RNA lacking genomic locations with appropriate RNA secondary structures to be defined miRNAs including information on frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 568 | ATAACACTAGAAAGTTGGGGCAGATTGC | 0 | 0 | 1 | 0 | 0 | 0 | 0.57 | 0 |
| 569 | ACGTGGGCACATTACCCGTCTGACCTGA | 0 | 0 | 0 | 1 | 0 | 0 | 0 | 0.29 |
| 570 | ACCCCTTATTAACCCA | 0 | 1 | 0 | 0 | 0 | 0.88 | 0 | 0 |
| 571 | ACAAGGCACACCTACACCCCTTATCCC | 0 | 0 | 1 | 0 | 0 | 0 | 0.57 | 0 |
| 572 | AAAAGACACCCCCCCACCA | 0 | 0 | 0 | 1 | 0 | 0 | 0 | 0.29 |
| 573 | AAAACCCCTACGCATTTATAT | 0 | 0 | 1 | 0 | 0 | 0 | 0.57 | 0 |
| 574 | AAAAAGACACCCCCCCACCA | 0 | 0 | 0 | 1 | 0 | 0 | 0 | 0.29 |
| 575 | ACCCCACTCCTGGTACCA | 1 | 11 | 5 | 6 | 1.72 | 9.73 | 2.84 | 1.75 |
| 576 | TGCCCCCATGTCTAACAACATGGCTA | 7 | 4 | 1 | 1 | 12.07 | 3.54 | 0.57 | 0.29 |
| 577 | GGCCGGTGATGAGAACT | 4 | 3 | 0 | 0 | 6.9 | 2.65 | 0 | 0 |
| 578 | CCCCGCCTGTTTACC | 0 | 5 | 2 | 0 | 0 | 4.42 | 1.14 | 0 |
| 579 | CCCACTTCTGACACCA | 3 | 4 | 0 | 0 | 5.17 | 3.54 | 0 | 0 |
| 580 | CACCACCTCTTGCTCAGCC | 1 | 3 | 0 | 0 | 1.72 | 2.65 | 0 | 0 |
| 581 | CTGGAAAGTGCACTTGGACGAACA | 0 | 2 | 0 | 0 | 0 | 1.77 | 0 | 0 |
| 582 | TGACCGCTCTGACCAC | 0 | 1 | 0 | 0 | 0 | 0.88 | 0 | 0 |
| 583 | TGAAGTCCCTTTGCTTTGTT | 1 | 0 | 0 | 0 | 1.72 | 0 | 0 | 0 |
| 584 | TGAACACACAATAGCTAAGACCC | 0 | 0 | 1 | 0 | 0 | 0 | 0.57 | 0 |
| 585 | TCGCCTTACCCCCCACTA | 0 | 1 | 0 | 0 | 0 | 0.88 | 0 | 0 |
| 586 | TCGATAAACCCCGATCAACCT | 0 | 0 | 1 | 0 | 0 | 0 | 0.57 | 0 |
| 587 | TCCCCGTCACCTCCACCA | 0 | 0 | 1 | 0 | 0 | 0 | 0.57 | 0 |
| 588 | TCCCCGGCACTCCACCA | 0 | 0 | 1 | 0 | 0 | 0 | 0.57 | 0 |
| 589 | TCCCCCCGCTGCCACCA | 1 | 0 | 0 | 0 | 1.72 | 0 | 0 | 0 |
| 590 | TCCCCCCCATCTCCACCA | 0 | 0 | 1 | 0 | 0 | 0 | 0.57 | 0 |
| 591 | TACACACCGCCCGTCACCC | 0 | 0 | 1 | 0 | 0 | 0 | 0.57 | 0 |
| 592 | GGCCGGTGATGAGAACTTCTCCC | 1 | 0 | 0 | 0 | 1.72 | 0 | 0 | 0 |
| 593 | GCTTAGCCTAGCCACACCCCCACG | 0 | 0 | 1 | 0 | 0 | 0 | 0.57 | 0 |
| 594 | GCTCGCCAGAACACTACGA | 0 | 0 | 1 | 0 | 0 | 0 | 0.57 | 0 |
| 595 | GCCGGGGGCGGGCGCA | 0 | 1 | 0 | 0 | 0 | 0.88 | 0 | 0 |
| 596 | GAACCGGGCGGGAACACCA | 0 | 0 | 0 | 1 | 0 | 0 | 0 | 0.29 |
| 597 | CGCCGCAGTACTGATCATTC | 0 | 0 | 1 | 0 | 0 | 0 | 0.57 | 0 |
| 598 | CCGCACCAATAGGATCCTCC | 0 | 1 | 0 | 0 | 0 | 0.88 | 0 | 0 |
| 599 | CCCGGCCGACGCACCA | 1 | 0 | 0 | 0 | 1.72 | 0 | 0 | 0 |
| 600 | CCACCCCATCATACTCTTTC | 0 | 0 | 1 | 0 | 0 | 0 | 0.57 | 0 |

TABLE 3B-continued

List of short-RNA lacking genomic locations with appropriate RNA secondary structures to be defined miRNAs including information on frequencies.

| SEQ ID NO: | Short-RNA sequence | Corrected Counts | | | | Frequencies | | | |
|---|---|---|---|---|---|---|---|---|---|
| | | Naive (N) | Memory (M) | Centroblasts (CB) | Ramos (RA) | Naive (N) | Memory (M) | Centroblasts (CB) | Ramos (RA) |
| 601 | CACCCCCCAGCTCCTCCTTT | 1 | 0 | 0 | 0 | 1.72 | 0 | 0 | 0 |
| 602 | ATAAGTAACATGAAAACATTCTCCTC | 0 | 0 | 1 | 0 | 0 | 0 | 0.57 | 0 |
| 603 | ACTGCTCGCCAGAACAC | 0 | 0 | 1 | 0 | 0 | 0 | 0.57 | 0 |
| 604 | ACCCTGGTGTGGGATCTGCCCGATC | 0 | 0 | 1 | 0 | 0 | 0 | 0.57 | 0 |
| 605 | AACCTCACCACCTCTTTCT | 0 | 0 | 1 | 0 | 0 | 0 | 0.57 | 0 |
| 606 | AAAAGACACCCCCCACACCA | 0 | 0 | 0 | 1 | 0 | 0 | 0 | 0.29 |
| 607 | GCTAAACCTAGCCCCAAACCC | 9 | 16 | 13 | 18 | 15.52 | 14.16 | 7.39 | 5.25 |
| 608 | GGCCGTGATCGTATA | 2 | 0 | 0 | 0 | 3.45 | 0 | 0 | 0 |
| 609 | TGGGATGCGAGAGGTCCCGGGT | 0 | 0 | 0 | 1 | 0 | 0 | 0 | 0.29 |
| 610 | CTGAACTCCTCACACCC | 0 | 1 | 0 | 0 | 0 | 0.88 | 0 | 0 |
| 611 | ATTAATCCCCTGGCCCAACCCG | 0 | 0 | 0 | 1 | 0 | 0 | 0 | 0.29 |
| 612 | AGCCCCAAACCCACTCCAC | 0 | 0 | 1 | 0 | 0 | 0 | 0.57 | 0 |
| 613 | CGCGACCTCAGATCAGAC | 1 | 5 | 8 | 1 | 1.72 | 4.42 | 4.55 | 0.29 |
| 614 | TCAAGTGATGTCATCTTACTACTGAGA | 0 | 0 | 3 | 1 | 0 | 0 | 1.7 | 0.29 |
| 615 | TTGGGTGCGAGAGGTCCCGGGT | 0 | 0 | 0 | 3 | 0 | 0 | 0 | 0.87 |
| 616 | TCTCGGTGGGACCTCCA | 0 | 2 | 0 | 0 | 0 | 1.77 | 0 | 0 |
| 617 | CCGCCCCCGTTCCCCC | 1 | 1 | 0 | 0 | 1.72 | 0.88 | 0 | 0 |
| 618 | CCCACTGCTAAATTTGACTGGCTT | 0 | 0 | 1 | 1 | 0 | 0 | 0.57 | 0.29 |
| 619 | ACAGACCAAGAGCCTTC | 0 | 0 | 2 | 0 | 0 | 0 | 1.14 | 0 |
| 620 | TGTAGTAGTCAATTAATGGATATTA | 0 | 0 | 1 | 0 | 0 | 0 | 0.57 | 0 |
| 621 | TGGTTATCACGTTCGCCTCACACGCGA | 0 | 0 | 0 | 1 | 0 | 0 | 0 | 0.29 |
| 622 | TGGGAATACCGGGTG | 0 | 0 | 1 | 0 | 0 | 0 | 0.57 | 0 |
| 623 | TGGCGGCCAAGCGTTCATAGCGACGTC | 0 | 0 | 0 | 1 | 0 | 0 | 0 | 0.29 |
| 624 | TCGTCATCCAGCTAAGGGCTCAGA | 0 | 0 | 1 | 0 | 0 | 0 | 0.57 | 0 |
| 625 | TCGCCTGCCACGCGGGAGGCCCGGGT | 0 | 0 | 1 | 0 | 0 | 0 | 0.57 | 0 |
| 626 | TCCCACTGCTTCACTTGA | 0 | 0 | 0 | 1 | 0 | 0 | 0 | 0.29 |
| 627 | GTTTAGACGGGCTCACATCACCCCA | 0 | 0 | 1 | 0 | 0 | 0 | 0.57 | 0 |
| 628 | GCTAACTCATGCCCCATGTC | 0 | 0 | 1 | 0 | 0 | 0 | 0.57 | 0 |
| 629 | GACTGTGGTGGTTGAATATA | 0 | 0 | 0 | 1 | 0 | 0 | 0 | 0.29 |
| 630 | CGCGACCTCAGATCAGACGTGGCGACC | 0 | 0 | 1 | 0 | 0 | 0 | 0.57 | 0 |
| 631 | CGCCGCCGCCCCCCC | 0 | 1 | 0 | 0 | 0 | 0.88 | 0 | 0 |

TABLE 3B-continued

List of short-RNA lacking genomic locations with appropriate RNA secondary structures to be defined miRNAs including information on frequencies.

| SEQ ID NO: | Short-RNA sequence | Corrected Counts | | | | Frequencies | | | |
|---|---|---|---|---|---|---|---|---|---|
| | | Naive (N) | Memory (M) | Centroblasts (CB) | Ramos (RA) | Naive (N) | Memory (M) | Centroblasts (CB) | Ramos (RA) |
| 632 | CGCCCGACTACCACCACATCCA | 1 | 0 | 0 | 0 | 1.72 | 0 | 0 | 0 |
| 633 | CCCCCCTCCACGCGCCC | 0 | 1 | 0 | 0 | 0 | 0.88 | 0 | 0 |
| 634 | CCCCACCCCGCGCCCTC | 0 | 1 | 0 | 0 | 0 | 0.88 | 0 | 0 |
| 635 | CAGAGTGTAGCTTAACACAAAGCACCCAA | 0 | 0 | 1 | 0 | 0 | 0 | 0.57 | 0 |
| 636 | CAATCTTGGCATGTTGGTCTGGTCACCCA | 0 | 0 | 1 | 0 | 0 | 0 | 0.57 | 0 |
| 637 | CAAAGCATCGCGAAGGCCC | 0 | 0 | 1 | 0 | 0 | 0 | 0.57 | 0 |
| 638 | AACACCCTGATTGCTCCTGTCTGAT | 0 | 0 | 1 | 0 | 0 | 0 | 0.57 | 0 |
| 639 | AAAAAGGGCCTAAAGAAGATGCA | 0 | 0 | 1 | 0 | 0 | 0 | 0.57 | 0 |

TABLE 4A

List of short-RNA consensus with maximum 1 mismatch to the human genome.

| ID | SEQ ID NO: | Short-RNA sequence | Annotations |
|---|---|---|---|
| CU-6232 | 640 | TGGCTCAGTTCAGCAGGAACAGT | Mature:hsa-miR-24:MIMAT0000080 |
| CU-6180 | 641 | GTGGGGGAGAGGCTGTCGA | Mature:hsa-miR-1275:MIMAT0005929 |
| CU-6130 | 642 | CGGGGCAGCTCAGTACAGGATT | Mature:hsa-miR-486-3p:MIMAT0004762 |
| CU-6044 | 643 | AATTGCACGGTATCCATCTGTAT | Mature:hsa-miR-363:MIMAT0000707 |
| CU-6133 | 644 | CGGGGGAGCGCCGCGTA | NEW |
| CU-6215 | 645 | TCGATCCCGGGTTTCGGCACCA | NEW |
| CU-6072 | 646 | ATCGTATCCCACTTCTGACACCA | NEW |
| CU-6030 | 647 | ATCCTGCCGACTACGCCA | NEW |
| CU-6210 | 648 | TCGAATCCCACTCCTGACACCA | NEW |
| CU-6069 | 649 | ATCCCATCCTCGTCGCCA | NEW |
| CU-6216 | 650 | TCGATTCCCCGACGGGGAGCCA | NEW |
| CU-6071 | 651 | ATCCGGGTGCCCCCTCCA | NEW |
| CU-6202 | 652 | TCCCGGGCGGCGCACCA | NEW |
| CU-6066 | 653 | ATCCCACCAGAGTCGCCA | NEW |
| CU-6192 | 654 | TCAAATCACGTCGGGGTCACCA | NEW |
| CU-6239 | 655 | TGTCAGTTTGTTAATTGACCCAA | NEW |
| CU-6214 | 656 | TCGATCCCCGTACGGGCCACCA | NEW |
| CU-6213 | 657 | TCGAGCCTCACCTGGAGCACCA | NEW |
| CU-6206 | 658 | TCCGGCTCGAAGGACCA | NEW |
| CU-6006 | 659 | GGCAATACGAGCACCCTG | NEW |
| CU-6004 | 660 | CCGGGGCGTCTCGTAC | NEW |
| CU-6056 | 661 | AGCGGCTGTGCACAAA | NEW |

TABLE 4A-continued

List of short-RNA consensus with maximum 1 mismatch to the human genome.

| ID | SEQ ID NO: | Short-RNA sequence | Annotations |
|---|---|---|---|
| CU-6242 | 662 | TGTCAGTTTGTTTAATCCAA | NEW |
| CU-6241 | 663 | TGTCAGTTTGTTATTACCAA | NEW |
| CU-6237 | 664 | TGTCAGGCACCATCAATAA | NEW |
| CU-6225 | 665 | TGATCTTGACACTTAAAGCC | NEW |
| CU-6219 | 666 | TCGTAGGCACCATCAAT | NEW |
| CU-6211 | 667 | TCGACTCCCGGTATGGGAACCA | NEW |
| CU-6187 | 668 | TAGGGAGGTTATGATTAACTTTT | NEW |
| CU-6183 | 669 | TAAAGTGCTTAGTGCAGGTA | NEW |
| CU-6181 | 670 | GTTTATGTTGCTTACCTCC | NEW |
| CU-6176 | 671 | GTAGATAAATATTGGCG | NEW |
| CU-6163 | 672 | GGCGGGGACGACGTCAG | NEW |
| CU-6162 | 673 | GGCGGCGTCGCGGCGGGTC | NEW |
| CU-6161 | 674 | GGAGGGGGTGAACAAAAAGAAAAA | NEW |
| CU-6159 | 675 | GCTAAACCTAGCCCCAAACCCACTCCACA | NEW |
| CU-6142 | 676 | CTGGATAGCGCACTTCGTT | NEW |
| CU-6129 | 677 | CGGGCGAGGGGCGGACGTTCG | NEW |
| CU-6123 | 678 | CGGACCTATACCGGA | NEW |
| CU-6096 | 679 | CCCCGGGTTCAATCCCCGGCACCTCCACCA | NEW |
| CU-6088 | 680 | CCCCCCACAACCGCGAA | NEW |
| CU-6087 | 681 | CCCAGCATCTCCTGTGTTTA | NEW |
| CU-6086 | 682 | CCCACGTTGGGACGCCA | NEW |
| CU-6064 | 683 | ATCACGTCCGTGCCTCCA | NEW |
| CU-6063 | 684 | ATAGCAATGTCAGCAGTACCT | NEW |
| CU-6051 | 685 | ACCCTGCTCGCTGCGCCA | refseqGeneIntron-annotate |
| CU-6198 | 686 | TCCCACCCAGGGACGCCA | refseqGeneIntron-annotate |
| CU-6218 | 687 | TCGTAGGCACATCAATA | refseqGeneIntron-annotate |
| CU-6007 | 688 | CCCCCACAACCGCGTA | refseqGeneIntron-annotate |
| CU-6001 | 689 | ACCCCGTCCGTGCCTCCA | refseqGeneIntron-annotate |
| CU-6039 | 690 | AAAAAAGACACCCCCCACA | refseqGeneIntron-annotate |
| CU-6005 | 691 | TGTCAGTTTGTTAACCCAA | refseqGeneIntron-annotate |
| CU-6204 | 692 | TCCCTGTGGTCTAGTGGTTAGG | refseqGeneIntron-annotate |
| CU-6172 | 693 | GGGGGGGTAAAAAAA | refseqGeneIntron-annotate |
| CU-6171 | 694 | GGGGGGGGAAAAAAAA | refseqGeneIntron-annotate |
| CU-6128 | 695 | CGGGCCCGGGTCTTCCC | refseqGeneIntron-annotate |
| CU-6002 | 696 | CCGCCCCCGTTCCCCCCA | refseqGeneIntron-annotate |
| CU-6050 | 697 | ACCCCCGGCTCCTCCACCA | refseqGeneIntron-annotate |
| CU-6244 | 698 | TTTGGTGGAAATTTTTTGA | refseqGeneIntron-annotate |

TABLE 4A-continued

List of short-RNA consensus with maximum 1 mismatch to the human genome.

| ID | SEQ ID NO: | Short-RNA sequence | Annotations |
|---|---|---|---|
| CU-6240 | 699 | TGTCAGTTTGTTATACCAA | refseqGeneIntron-annotate |
| CU-6238 | 700 | TGTCAGTTTGTAATTATCCCAA | refseqGeneIntron-annotate |
| CU-6236 | 701 | TGTCAATTTTTAACCCAA | refseqGeneIntron-annotate |
| CU-6227 | 702 | TGCTAGGGTAAAAAAAAA | refseqGeneIntron-annotate |
| CU-6226 | 703 | TGCAACTCCAAATAAAAGTACCA | refseqGeneIntron-annotate |
| CU-6224 | 704 | TGAGGTAACGGGGAATTA | refseqGeneIntron-annotate |
| CU-6209 | 705 | TCCTCGGCATCTCCACCA | refseqGeneIntron-annotate |
| CU-6197 | 706 | TCATATGAAGTCACCCTAGCCATC | mitochondrion-annotate;refseqGeneIntron-annotate |
| CU-6196 | 707 | TCAGTTTGTTTATTAACCCAA | refseqGeneIntron-annotate |
| CU-6195 | 708 | TCAGCGTGTCTTTGCCCT | refseqGeneIntron-annotate |
| CU-6194 | 709 | TCACTGGTGGTCTAGTGGT | refseqGeneIntron-annotate;rnaGene-annotate |
| CU-6193 | 710 | TCACAATGCTGCCACCA | refseqGeneIntron-annotate |
| CU-6189 | 711 | TAGTTGTTAATTAACCCAA | refseqGeneIntron-annotate |
| CU-6188 | 712 | TAGTCCTCATCGCCCTCC | mitochondrion-annotate;refseqGeneIntron-annotate |
| CU-6184 | 713 | TAAAGTGCTTATAGTGCGGGTAA | refseqGeneIntron-annotate |
| CU-6179 | 714 | GTCCCACCAGAGTCGCCA | refseqGeneIntron-annotate |
| CU-6170 | 715 | GGGGGAGGGGCCAAAAAAA | refseqGeneIntron-annotate |
| CU-6167 | 716 | GGGACGCCGCGGTGTCG | refseqGeneIntron-annotate |
| CU-6166 | 717 | GGGAATACCGGGTGCTTTAGGCTT | refseqGeneIntron-annotate;rnaGene-annotate |
| CU-6160 | 718 | GGAAGAAGGTGGTGGTATA | refseqGeneIntron-annotate |
| CU-6156 | 719 | GCGGTGAAATGCGTA | computGene-annotate;Ecoli-annotate; refseqGeneIntron-annotate |
| CU-6154 | 720 | GCGGGGAAGGTGGCAAA | refseqGeneIntron-annotate |
| CU-6152 | 721 | GCGACGACCTCGCGCCCACCTGGTCA | refseqGeneIntron-annotate |
| CU-6151 | 722 | GCCACCCGATACTGCTGT | refseqGeneIntron-annotate |
| CU-6150 | 723 | GATGTATGCTTTGTTTCTGTT | refseqGeneIntron-annotate |
| CU-6148 | 724 | GAGGGGGATTTAGAAAAAAA | refseqGeneIntron-annotate |
| CU-6147 | 725 | GAAGGAAAGTTCTATAGT | refseqGeneIntron-annotate |
| CU-6146 | 726 | GAAGCGGCTCTCTTATTT | refseqGeneIntron-annotate |
| CU-6145 | 727 | GAACGAGACTCTGGCATGCTGA | refseqGeneIntron-annotate;rnaGene-annotate |
| CU-6143 | 728 | CTGGTAGGCCCATCAAT | refseqGeneIntron-annotate |
| CU-6132 | 729 | CGGGGCCGATCGCGCGC | computGene-annotate;refseqGeneIntron-annotate |
| CU-6125 | 730 | CGGCCCCGGGTTCCTCCC | computGene-annotate;refseqGeneIntron-annotate |
| CU-6118 | 731 | CGAGCCCGGTTAGTA | refseqGeneIntron-annotate;rnaGene-annotate |
| CU-6117 | 732 | CGACTCTTAGCGGTGGA | piRNA-annotate;refseqGeneIntron-annotate |
| CU-6116 | 733 | CGAATCCCACTTCTGACACCA | refseqGeneIntron-annotate |
| CU-6113 | 734 | CGAAAGGGAATCGGGTC | refseqGeneIntron-annotate |
| CU-6112 | 735 | CCTTAGGTCGCTGGTAAA | refseqGeneIntron-annotate |

TABLE 4A-continued

List of short-RNA consensus with maximum 1 mismatch to the human genome.

| ID | SEQ ID NO: | Short-RNA sequence | Annotations |
|---|---|---|---|
| CU-6108 | 736 | CCGTGCGAGAATACCA | refseqGeneIntron-annotate |
| CU-6107 | 737 | CCGGTCTCTCAAGCGGCC | refseqGeneIntron-annotate |
| CU-6099 | 738 | CCCGGCCCTCGCGCGTCC | computGene-annotate;refseqGeneIntron-annotate |
| CU-6094 | 739 | CCCCGGCATTTCCACCA | computGene-annotate;refseqGeneIntron-annotate |
| CU-6090 | 740 | CCCCCCCGGCTCCTCCACCA | refseqGeneIntron-annotate |
| CU-6089 | 741 | CCCCCCACAACCGCTA | refseqGeneIntron-annotate |
| CU-6085 | 742 | CCCAAGTATTGACTCACCC | mitochondrion-annotate;refseqGeneIntron-annotate |
| CU-6084 | 743 | CCAGTAAGCGCGAGTC | refseqGeneIntron-annotate |
| CU-6082 | 744 | CCAAAGAAAGCACGTAGAG | refseqGeneIntron-annotate |
| CU-6081 | 745 | CATGTTTAACGGCCGCGGT | mitochondrion-annotate;refseqGeneIntron-annotate |
| CU-6080 | 746 | CAGTTTGTAATTAACCCAA | refseqGeneIntron-annotate |
| CU-6079 | 747 | CAGGAACGGCGCACCA | computGene-annotate;refseqGeneIntron-annotate |
| CU-6078 | 748 | CAGAACCCTCTAAATCCCC | mitochondnon-annotate;refseqGeneIntron-annotate |
| CU-6076 | 749 | CACCCGGCTGTGTGCACATGTGT | miRBASE-annotate;computGene-annotate; refseqGeneIntron-annotate;wgRNA-annotate |
| CU-6075 | 750 | CAATTGGACCAATCTATC | mitochondnion-annotate;refseqGeneIntron-annotate |
| CU-6074 | 751 | ATTCCTGTACTGCGATA | refseqGeneIntron-annotate |
| CU-6070 | 752 | ATCCCTGCGGCGTCTCCA | refseqGeneIntron-annotate |
| CU-6067 | 753 | ATCCCACCGCTGCCATCA | refseqGeneIntron-annotate |
| CU-6062 | 754 | AGTCAATAGAAGCCGGCGTA | mitochondnion-annotate;refseqGeneIntron-annotate |
| CU-6061 | 755 | AGGTTCGTTTGTAAAAA | refseqGeneIntron-annotate |
| CU-6060 | 756 | AGGTCCTGGGTTTAAGTGT | coMputGene-annotate;refseqGeneIntron-annotate |
| CU-6058 | 757 | AGGGGGAAGTTCTATAGTC | refseqGeneIntron-annotate |
| CU-6057 | 758 | AGGCTGTGATGCTCTCNTGAGCCCT | refseqGeneIntron-annotate |
| CU-6055 | 759 | AGCCCCTCTCCGGCCCTTA | refseqGeneIntron-annotate |
| CU-6054 | 760 | ACTACCACCTACCTCCC | mitochondnion-annotate;refseqGeneIntron-annotate |
| CU-6052 | 761 | ACGCCCTTCCCCCCCTTCTTT | miRBASE-annotate;refseqGeneIntron-annotate |
| CU-6049 | 762 | ACCCCACTCCTGGTGCAC | refseqGeneIntron-annotate |
| CU-6048 | 763 | ACCACCTGATCCCTTCCC | refseqGeneIntron-annotate |
| CU-6047 | 764 | ACAGCTAAGCACCCACCA | refseqGeneIntron-annotate |
| CU-6045 | 765 | ACACATGTTTAACGGCC | mitochondrion-annotate;refseqGeneIntron-annotate |
| CU-6043 | 766 | AATTAGGGACCTGTATG | refseqGeneIntron-annotate |
| CU-6042 | 767 | AATGGCCCATTTGGGCAAACA | computGene-annotate;refseqGeneIntron-annotate |
| CU-6041 | 768 | AAAGCGGCTGTGCAAACA | refseqGeneIntron-annotate |
| CU-6212 | 769 | TCGACTCCTGGCTGGCTCGCCA | wgRNA-annotate |
| CU-6200 | 770 | TCCCCGGCATCTCCACCAA | computGene-annotate |
| CU-6157 | 771 | GCGGTGGATCACTCGGCTCGTGCGT | rnaGene-annotate |
| CU-6105 | 772 | CCGGGTGTTGTAGA | mRNAall-annotate;exEID-annotate |

TABLE 4A-continued

List of short-RNA consensus with maximum 1 mismatch to the human genome.

| ID | SEQ ID NO: | Short-RNA sequence | Annotations |
|---|---|---|---|
| CU-6235 | 773 | TGTAGCGTGGCCGAGCGGT | rnaGene-annotate |
| CU-6234 | 774 | TGGGGCGACCTCGGAGCAG | mitochondrion-annotate |
| CU-6230 | 775 | TGGCGTCCTAAGCCAGGGATTGTGGGT | rnaGene-annotate |
| CU-6229 | 776 | TGGCAGGGGAGATACCATGATTT | rnaGene-annotate |
| CU-6222 | 777 | TCTGATCAGGGTGAGCATC | mitochondrion-annotate |
| CU-6220 | 778 | TCGTAGGCACCATCCAT | computGene-annotate |
| CU-6165 | 779 | GGGAAACGGGGCGCGGCTG | rnaGene-annotate |
| CU-6137 | 780 | CTACTCCTGCTCGCATCTGCTATA | mitochondrion-annotate |
| CU-6135 | 781 | CGGGTGGGTTTTTACCGG | computGene-annotate |
| CU-6120 | 782 | CGAGGAATTCCCAGTAAG | rnaGene-annotate |
| CU-6115 | 783 | CGAACGCACTTGCGGCCCC | rnaGene-annotate |
| CU-6093 | 784 | CCCCGCGCGGGTTCGAATC | rnaGene-annotate |
| CU-6059 | 785 | AGGGGTATGATTCCCGCTT | rnaGene-annotate |
| CU-6131 | 786 | CGGGGCCACGCGCGCGTC | mRNA-annotate;rRNA-eliminate |
| CU-6032 | 787 | TGGCGCTGCGGGATGAAC | rRNA-eliminate;refseqGeneIntron-annotate; rnaGene-annotate |
| CU-1153 | 788 | CCCCCCACTGCTAAATTTGACTGGCTT | yRNA-eliminate;refseqGeneIntron-annotate; rnaGene-annotate |
| CU-6182 | 789 | TAAAGGTTCGTTTGTAAAA | computGene-annotate;refseqGeneExon-eliminate |
| CU-6033 | 790 | CGGGGCCGAGGGAGCGA | rRNA-eliminate;refseqGeneExon-eliminate; refseqGeneIntron-annotate |
| CU-6174 | 791 | GGGTTAGGCCTCTTTT | tRNA-eliminate;rnaGene-annotate |
| CU-6141 | 792 | CTGCGGAAGGATCATTA | rRNA-eliminate;rnaGene-annotate |
| CU-6101 | 793 | CCCTACCCCCCCGG | rRNA-eliminate;refseqGeneIntron-annotate |
| CU-6034 | 794 | CCCGCCGGGTCCGCCC | computGene-annotate;rRNA-eliminate;refseqGeneExon-eliminate;refseqGeneIntron-annotate;rnaGene-annotate |
| CU-6035 | 795 | CCCCGCGCCCTCTCTCTCTC | rRNA-eLiminate;refseqGeneIntron-annotate |
| CU-6028 | 796 | CAGGCCTCCCTGGAATC | computGene-annotate;refseqGeneExon-eliminate; refseqGeneIntron-annotate |
| CU-6029 | 797 | AGTCCCACCCGGGGTACCA | computGene-annotate;refseqGeneExon-eliminate |
| CU-6243 | 798 | TTGACACGCCCCAGTGCCCTGT | refseqGeneExon-eliminate |
| CU-6233 | 799 | TGGGAGCGGGCGGGCGGTC | rRNA-eliminate;rnaGene-annotate |
| CU-6231 | 800 | TGGCGTGGAGCGGGCGT | rRNA-eliminate;refseqGeneIntron-annotate |
| CU-6228 | 801 | TGGAGGTCCGTAGCGGT | rRNA-eliminate;mRNA-annotate;refseqGeneIntron-annotate;rnaGene-annotate |
| CU-6223 | 802 | TGAAGAAGGTCTCGAACA | computGene-annotate;refseqGeneExon-eliminate |
| CU-6221 | 803 | TCTCGCCGGGGCTTCCA | computGene-annotate;refseqGeneExon-eliminate; rnaGene-annotate |
| CU-6217 | 804 | TCGTAGCACCATCAATAA | computGene-annotate;refseqGeneExon-eliminate |
| CU-6208 | 805 | TCCGGGTCCCCCCTCCA | computGene-annotate;refseqGeneExon-eliminate; refseqGeneIntron-annotate |

TABLE 4A-continued

List of short-RNA consensus with maximum 1 mismatch to the human genome.

| ID | SEQ ID NO: | Short-RNA sequence | Annotations |
|---|---|---|---|
| CU-6207 | 806 | TCCGGGGCTGCACGCGCGCT | rRNA-eliminate;rnaGene-annotate |
| CU-6205 | 807 | TCCGGCCGTGTCGGT | computGene-annotate;refseqGeneExon-eliminate; refseqGeneIntron-annotate |
| CU-6203 | 808 | TCCCTGTCCTCCAGGAGT | miRBASE-annotate;computGene-annotate;refseqGene-Exon-eliminate;refseqGeneIntron-annotate;wgRNA-annotate |
| CU-6201 | 809 | TCCCCTCCTCGTCGCCA | refseqGeneExon-eliminate;refseqGeneIntron-annotate |
| CU-6199 | 810 | TCCCAGGTAGTCTAGTGGT | refseqGeneExon-eliminate;refseqGeneIntron-annotate; rnaGene-annotate |
| CU-6191 | 811 | TATTCATTTATCCCCAGCCTAT | miRBASE-annotate;snoRNA-eliminate;refseqGeneIntron-annotate;wgRNA-annotate;rnaGene-annotate |
| CU-6190 | 812 | TAGTTGTTATAACCCAA | refseqGeneExon-eliminate;refseqGeneIntron-annotate |
| CU-6186 | 813 | TAGATCACCCCCTCCCC | mitochondrion-annotate;refseqGeneExon-eliminate; refseqGeneIntron-annotate |
| CU-6185 | 814 | TACCGGCACCTGGCGCC | computGene-annotate;refseqGeneExon-eliminate; refseqGeneIntron-annotate |
| CU-6178 | 815 | GTATAGGGGCGAAAGAC | rRNA-eliminate;mRNA-annotate;refseqGeneIntron-annotate;rnaGene-annotate |
| CU-6177 | 816 | GTAGCTGGTTCCCTCCGAA | rRNA-eliminate;mRNA-annotate;refseqGeneIntron-annotate;rnaGene-annotate |
| CU-6175 | 817 | GGTAAGAAGCCCGGCTC | computGene-annotate;rRNA-eliminate;refseqGeneExon-eliminate;refseqGeneIntron-annotate;rnaGene-annotate |
| CU-6173 | 818 | GGGGGGGTTTAAAAAAAA | refseqGeneExon-eliminate;refseqGeneIntron-annotate |
| CU-6169 | 819 | GGGGCGCACTACCGGCC | refseqGeneExon-eliminate |
| CU-6168 | 820 | GGGAGAGGCTGTCGCTGCG | computGene-annotate;refseqGeneExon-eliminate |
| CU-6164 | 821 | GGCGGGTGAAGCGGCG | computGene-annotate;refseqGeneExon-eliminate; refseqGeneIntron-annotate |
| CU-6158 | 822 | GCGGTTCCGGCGGCGTC | rRNA-eliminate;refseqGeneExon-eliminate; refseqGeneIntron-annotate |
| CU-6155 | 823 | GCGGGGCGCCTAGGCCTGGTTTGT | refseqGeneExon-eliminate |
| CU-6153 | 824 | GCGGCGGTCGGCGGGCGGCGGG | rRNA-eliminate;refseqGeneExon-eliminate; refseqGeneIntron-annotate |
| CU-6149 | 825 | GAGGGGGGGGGTGGGGGGGGA | refseqGeneExon-eliminate;refseqGeneIntron-annotate |
| CU-6144 | 826 | CTGTCGGCCACCATCAT | computGene-annotate;refseqGeneExon-eliminate; refseqGeneIntron-annotate |
| CU-6140 | 827 | CTGCAACTCGACCCCA | computGene-annotate;refseqGeneExon-eliminate; refseqGeneIntron-annotate |
| CU-6139 | 828 | CTCCTCTCCCCGCCCGCCG | refseqGeneExon-eliminate;refseqGeneIntron-annotate |
| CU-6138 | 829 | CTCAAAGATTAAGCCATGCATGTCTA | rRNA-eliminate;rnaGene-annotate |
| CU-6136 | 830 | CTACGCCGCGACGAG | computGene-annotate;rRNA-eliminate |
| CU-6134 | 831 | CGGGTGACGGGGAATCAGGGTT | rRNA-eliminate;rnaGene-annotate |
| CU-6127 | 832 | CGGGCAGCTTCCGGGA | computGene-annotate;rRNA-eliminate;refseqGeneExon-eliminate;refseqGeneIntron-annotate |
| CU-6126 | 833 | CGGGAGGCCCGGGTCCTG | refseqGeneExon-eliminate;refseqGeneIntron-annotate |

TABLE 4A-continued

List of short-RNA consensus with maximum 1 mismatch to the human genome.

| ID | SEQ ID NO: | Short-RNA sequence | Annotations |
|---|---|---|---|
| CU-6124 | 834 | CGGCCCCGCATCCTCCC | computGene-annotate;refseqGeneExon-eliminate; refseqGeneIntron-annotate |
| CU-6122 | 835 | CGCGGGTAAACGGCGGGAGTAACTAT | mRNAall-annotate;rRNA-eliminate;refseqGeneIntron-annotate;rnaGene-annotate |
| CU-6121 | 836 | CGCCCCCGTTCCCCCTCC | rRNA-eliminate |
| CU-6119 | 837 | CGAGCGGAAACACCA | computGene-annotate;refseqGeneExon-eliminate; refseqGeneIntron-annotate |
| CU-6114 | 838 | CGAACCCGGCACCGC | computGene-annotate;refseqGeneExon-eliminate; refseqGeneIntron-annotate |
| CU-6111 | 839 | CCTCGGGCCGATCGCAC | rRNA-eliminate;rnaGene-annotate |
| CU-6110 | 840 | CCTATATATCTTACCA | computGene-annotate;refseqGeneExon-eliminate; refseqGeneIntron-annotate |
| CU-6109 | 841 | CCGTGGCGGCGACGACC | computGene-annotate;rRNA-eliminate;refseqGeneExon-eliminate |
| CU-6106 | 842 | CCGGGTTCCGGCACCA | computGene-annotate;refseqGeneExon-eliminate; refseqGeneIntron-annotate |
| CU-6104 | 843 | CCGCGAGGGGGGCCCG | computGene-annotate;refseqGeneExon-eliminate; refseqGeneIntron-annotate |
| CU-6103 | 844 | CCGCCTCACGGGACCA | computGene-annotate;refseqGeneExon-eliminate; refseqGeneIntron-annotate |
| CU-6102 | 845 | CCGCCCGTCCCCGCCCTTG | rRNA-eliminate;refseqGeneIntron-annotate;rnaGene-annotate |
| CU-6100 | 846 | CCCGGGGCCGCGGTTCCG | computGene-annotate;rRNA-eliminate;refseqGeneIntron-annotate |
| CU-6098 | 847 | CCCGAGCCGCCTGGAT | computGene-annotate;rRNA-eliminate;refseqGeneExon-eliminate;refseqGeneIntron-annotate;rnaGene-annotate |
| CU-6097 | 848 | CCCGACGGCCGAACT | computGene-annotate;refseqGeneExon-eliminate; refseqGeneIntron-annotate |
| CU-6095 | 849 | CCCCGGGGAGCCCGGCGGG | computGene-annotate;refseqGeneExon-eliminate; refseqGeneIntron-annotate |
| CU-6092 | 850 | CCCCCTCGCGGCCCTCCC | rRNA-eliminate;refseqGeneIntron-annotate |
| CU-6091 | 851 | CCCCCCGTGGCGGCGAC | rRNA-eliminate;refseqGeneIntron-annotate |
| CU-6083 | 852 | CCACCCAGGGCACGCCA | refseqGeneExon-eliminate;refseqGeneIntron-annotate |
| CU-6077 | 853 | CACGGGTGACGGGGAA | computGene-annotate;rnaGene-annotate; refseqGeneIntron-annotate;rRNA-eliminate; refseqGeneExon-eliminate;piRNA-annotate |
| CU-6073 | 854 | ATGGGGAGGAAAAAAAAAAAAAA | refseqGeneExon-eliminate;refseqGeneIntron-annotate |
| CU-6068 | 855 | ATCCCACCGCTGCCCCCA | computGene-annotate;refseqGeneExon-eliminate; refseqGeneIntron-annotate |
| CU-6065 | 856 | ATCACGTCGGTCACCA | computGene-annotate;refseqGeneExon-eliminate; refseqGeneIntron-annotate |
| CU-6053 | 857 | ACGGGAAACCTCACCCGGCCCGG | rRNA-eliminate;piRNA-annotate;rnaGene-annotate |
| CU-6046 | 858 | ACAGAGGCTTACGACCCCTTATTT | mitochondrion-annotate;tRNA-eliminate; refseqGeneIntron-annotate;rnaGene-annotate |
| CU-6040 | 859 | AAAAAGGCATAATTAAACTT | mitochondrion-annotate;refseqGeneExon-eliminate; refseqGeneIntron-annotate |

TABLE 4B

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 860 | TGGCTCAGTTCAGCAGGAACAGT | 0 | 0 | 1 | 0 | 0 | 0 | 1.05 | 0 |
| 861 | GTGGGGGAGAGGCTGTCGA | 0 | 0 | 0 | 1 | 0 | 0 | 0 | 0.81 |
| 862 | CGGGGCAGCTCAGTACAGGATT | 0 | 0 | 1 | 0 | 0 | 0 | 1.05 | 0 |
| 863 | AATTGCACGGTATCCATCTGTAT | 0 | 0 | 1 | 0 | 0 | 0 | 1.05 | 0 |
| 864 | CGGGGGAGCGCCGCGTA | 2 | 0 | 0 | 0 | 2.04 | 0 | 0 | 0 |
| 865 | TCGATCCCGGGTTTCGGCACCA | 0 | 0 | 1 | 0 | 0 | 0 | 1.05 | 0 |
| 866 | ATCGTATCCCACTTCTGACACCA | 0 | 0 | 0 | 1 | 0 | 0 | 0 | 0.81 |
| 867 | ATCCTGCCGACTACGCCA | 13 | 15 | 13 | 613.27 | 13.76 | 13.68 | 4.88 | |
| 868 | TCGAATCCCACTCCTGACACCA | 1 | 2 | 7 | 71.02 | 1.83 | 7.37 | 5.69 | |
| 869 | ATCCCATCCTCGTCGCCA | 0 | 0 | 10 | 3 | 0 | 0 | 10.53 | 2.44 |
| 870 | TCGATTCCCCGACGGGGAGCCA | 1 | 1 | 1 | 9 | 1.02 | 0.92 | 1.05 | 7.32 |
| 871 | ATCGGGTGCCCCCTCCA | 2 | 4 | 0 | 1 | 2.04 | 3.67 | 0 | 0.81 |
| 872 | TCCCGGGCGGCGCACCA | 2 | 2 | 1 | 0 | 2.04 | 1.83 | 1.05 | 0 |
| 873 | ATCCCACCAGAGTCGCCA | 0 | 0 | 2 | 3 | 0 | 0 | 2.11 | 2.44 |
| 874 | TCAAATCACGTCGGGGTCACCA | 0 | 1 | 2 | 0 | 0 | 0.92 | 2.11 | 0 |
| 875 | TGTCAGTTTGTTAATTGACCCAA | 0 | 0 | 1 | 1 | 0 | 0 | 1.05 | 0.81 |
| 876 | TCGATCCCCGTACGGGCCACCA | 0 | 0 | 1 | 1 | 0 | 0 | 1.05 | 0.81 |
| 877 | TCGAGCCTCACCTGGAGCACCA | 0 | 0 | 2 | 0 | 0 | 0 | 2.11 | 0 |
| 878 | TCCGGCTCGAAGGACCA | 0 | 0 | 2 | 0 | 0 | 0 | 2.11 | 0 |
| 879 | GGCAATACGAGCACCCTG | 2 | 0 | 0 | 0 | 2.04 | 0 | 0 | 0 |
| 880 | CCGGGGCGTCTCGTAC | 2 | 0 | 0 | 0 | 2.04 | 0 | 0 | 0 |
| 881 | AGCGGCTGTGCACAAA | 0 | 0 | 0 | 2 | 0 | 0 | 0 | 1.63 |
| 882 | TGTCAGTTTGTTTAATCCAA | 0 | 0 | 0 | 1 | 0 | 0 | 0 | 0.81 |
| 883 | TGTCAGTTTGTTATTACCAA | 0 | 0 | 0 | 1 | 0 | 0 | 0 | 0.81 |
| 884 | TGTCAGGCACCATCAATAA | 0 | 0 | 0 | 1 | 0 | 0 | 0 | 0.81 |
| 885 | TGATCTTGACACTTAAAGCC | 0 | 0 | 0 | 1 | 0 | 0 | 0 | 0.81 |
| 886 | TCGTAGGCACCATCAAT | 0 | 0 | 0 | 1 | 0 | 0 | 0 | 0.81 |
| 887 | TCGACTCCCGGTATGGGAACCA | 0 | 0 | 0 | 1 | 0 | 0 | 0 | 0.81 |
| 888 | TAGGGAGGTTATGATTAACTTTT | 0 | 0 | 0 | 1 | 0 | 0 | 0 | 0.81 |
| 889 | TAAAGTGCTTAGTGCAGGTA | 0 | 0 | 0 | 1 | 0 | 0 | 0 | 0.81 |
| 890 | GTTTATGTTGCTTACCTCC | 0 | 0 | 1 | 0 | 0 | 0 | 1.05 | 0 |
| 891 | GTAGATAAATATTGGCG | 1 | 0 | 0 | 0 | 1.02 | 0 | 0 | 0 |
| 892 | GGCGGGACGACGTCAG | 0 | 0 | 0 | 1 | 0 | 0 | 0 | 0.81 |
| 893 | GGCGGCGTCGCGGCGGGTC | 0 | 1 | 0 | 0 | 0 | 0.92 | 0 | 0 |
| 894 | GGAGGGGGTGAACAAAAAGAAAAA | 0 | 0 | 0 | 1 | 0 | 0 | 0 | 0.81 |
| 895 | GCTAAACCTAGCCCCAAACCCACTCCACA | 0 | 0 | 0 | 1 | 0 | 0 | 0 | 0.81 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 896 | CTGGATAGCGCACTTCGTT | 0 | 0 | 0 | 1 | 0 | 0 | 0 | 0.81 |
| 897 | CGGGCGAGGGGCGGACGTTCG | 0 | 0 | 1 | 0 | 0 | 0 | 1.05 | 0 |
| 898 | CGGACCTATACCGGA | 1 | 0 | 0 | 0 | 1.02 | 0 | 0 | 0 |
| 899 | CCCCGGGTTCAATCCCCGGCACCTCCACCA | 0 | 0 | 1 | 0 | 0 | 0 | 1.05 | 0 |
| 900 | CCCCCCACAACCGCGAA | 0 | 1 | 0 | 0 | 0 | 0.92 | 0 | 0 |
| 901 | CCCAGCATCTCCTGTGTTTA | 0 | 1 | 0 | 0 | 0 | 0.92 | 0 | 0 |
| 902 | CCCACGTTGGGACGCCA | 1 | 0 | 0 | 0 | 1.02 | 0 | 0 | 0 |
| 903 | ATCACGTCCGTGCCTCCA | 0 | 1 | 0 | 0 | 0 | 0.92 | 0 | 0 |
| 904 | ATAGCAATGTCAGCAGTACCT | 0 | 0 | 1 | 0 | 0 | 0 | 1.05 | 0 |
| 905 | ACCCTGCTCGCTGCGCCA | 9 | 17 | 4 | 7 | 9.18 | 15.6 | 4.21 | 5.69 |
| 906 | TCCCACCCAGGGACGCCA | 8 | 2 | 1 | 0 | 8.16 | 1.83 | 1.05 | 0 |
| 907 | TCGTAGGCACATCAATA | 0 | 0 | 0 | 4 | 0 | 0 | 0 | 3.25 |
| 908 | CCCCCACAACCGCGTA | 0 | 4 | 0 | 0 | 0 | 3.67 | 0 | 0 |
| 909 | ACCCCGTCCGTGCCTCCA | 2 | 1 | 1 | 0 | 2.04 | 0.92 | 1.05 | 0 |
| 910 | AAAAAGACACCCCCACA | 0 | 0 | 0 | 3 | 0 | 0 | 0 | 2.44 |
| 911 | TGTCAGTTTGTTAACCCAA | 0 | 0 | 0 | 2 | 0 | 0 | 0 | 1.63 |
| 912 | TCCCTGTGGTCTAGTGGTTAGG | 0 | 0 | 1 | 1 | 0 | 0 | 1.05 | 0.81 |
| 913 | GGGGGGGTAAAAAAA | 0 | 0 | 0 | 1 | 0 | 0 | 0 | 0.81 |
| 914 | GGGGGGGGAAAAAAAA | 0 | 0 | 0 | 1 | 0 | 0 | 0 | 0.81 |
| 915 | CGGGCCCGGGTCTTCCC | 1 | 1 | 0 | 0 | 1.02 | 0.92 | 0 | 0 |
| 916 | CCGCCCCCGTTCCCCCCA | 0 | 2 | 0 | 0 | 0 | 1.83 | 0 | 0 |
| 917 | ACCCCCGGCTCCTCCACCA | 0 | 1 | 0 | 1 | 0 | 0.92 | 0 | 0.81 |
| 918 | TTTGGTGGAAATTTTTTGA | 0 | 0 | 0 | 1 | 0 | 0 | 0 | 0.81 |
| 919 | TGTCAGTTTGTTATACCAA | 0 | 0 | 0 | 1 | 0 | 0 | 0 | 0.81 |
| 920 | TGTCAGTTTGTAATTATCCCAA | 0 | 0 | 0 | 1 | 0 | 0 | 0 | 0.81 |
| 921 | TGTCAATTTTTAACCCAA | 0 | 0 | 0 | 1 | 0 | 0 | 0 | 0.81 |
| 922 | TGCTAGGGTAAAAAAAAAA | 0 | 0 | 0 | 1 | 0 | 0 | 0 | 0.81 |
| 923 | TGCAACTCCAAATAAAAGTACCA | 0 | 0 | 0 | 1 | 0 | 0 | 0 | 0.81 |
| 924 | TGAGGTAACGGGGAATTA | 0 | 0 | 0 | 1 | 0 | 0 | 0 | 0.81 |
| 925 | TCCTCGGCATCTCCACCA | 0 | 0 | 1 | 0 | 0 | 0 | 1.05 | 0 |
| 926 | TCATATGAAGTCACCCTAGCCATC | 0 | 0 | 1 | 0 | 0 | 0 | 1.05 | 0 |
| 927 | TCAGTTTGTTTATTAACCCAA | 0 | 0 | 0 | 1 | 0 | 0 | 0 | 0.81 |
| 928 | TCAGCGTGTCTTTGCCCT | 1 | 0 | 0 | 0 | 1.02 | 0 | 0 | 0 |
| 929 | TCACTGGTGGTCTAGTGGT | 0 | 1 | 0 | 0 | 0 | 0.92 | 0 | 0 |
| 930 | TCACAATGCTGCCACCA | 1 | 0 | 0 | 0 | 1.02 | 0 | 0 | 0 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 931 | TAGTTGTTAATTAACCCAA | 0 | 0 | 0 | 1 | 0 | 0 | 0 | 0.81 |
| 932 | TAGTCCTCATCGCCCTCC | 0 | 1 | 0 | 0 | 0 | 0.92 | 0 | 0 |
| 933 | TAAAGTGCTTATAGTGCGGGTAA | 0 | 0 | 0 | 1 | 0 | 0 | 0 | 0.81 |
| 934 | GTCCCACCAGAGTCGCCA | 0 | 0 | 1 | 0 | 0 | 0 | 1.05 | 0 |
| 935 | GGGGGAGGGGCCAAAAAA | 0 | 0 | 0 | 1 | 0 | 0 | 0 | 0.81 |
| 936 | GGGACGCCGCGGTGTCG | 1 | 0 | 0 | 0 | 1.02 | 0 | 0 | 0 |
| 937 | GGGAATACCGGGTGCTTTAGGCTT | 0 | 1 | 0 | 0 | 0 | 0.92 | 0 | 0 |
| 938 | GGAAGAAGGTGGTGGTATA | 0 | 0 | 0 | 1 | 0 | 0 | 0 | 0.81 |
| 939 | GCGGTGAAATGCGTA | 1 | 0 | 0 | 0 | 1.02 | 0 | 0 | 0 |
| 940 | GCGGGGAAGGTGGCAAA | 0 | 0 | 0 | 1 | 0 | 0 | 0 | 0.81 |
| 941 | GCGACGACCTCGCGCCCACCTGGTCA | 0 | 1 | 0 | 0 | 0 | 0.92 | 0 | 0 |
| 942 | GCCACCCGATACTGCTGT | 0 | 1 | 0 | 0 | 0 | 0.92 | 0 | 0 |
| 943 | GATGTATGCTTTGTTTCTGTT | 0 | 0 | 1 | 0 | 0 | 0 | 1.05 | 0 |
| 944 | GAGGGGGATTTAGAAAAAAA | 0 | 0 | 0 | 1 | 0 | 0 | 0 | 0.81 |
| 945 | GAAGGAAAGTTCTATAGT | 0 | 0 | 0 | 1 | 0 | 0 | 0 | 0.81 |
| 946 | GAAGCGGCTCTCTTATTT | 0 | 0 | 0 | 1 | 0 | 0 | 0 | 0.81 |
| 947 | GAACGAGACTCTGGCATGCTGA | 0 | 0 | 1 | 0 | 0 | 0 | 1.05 | 0 |
| 948 | CTGGTAGGCCCATCAAT | 0 | 0 | 0 | 1 | 0 | 0 | 0 | 0.81 |
| 949 | CGGGGCCGATCGCGCGC | 0 | 1 | 0 | 0 | 0 | 0.92 | 0 | 0 |
| 950 | CGGCCCCGGGTTCCTCCC | 1 | 0 | 0 | 0 | 1.02 | 0 | 0 | 0 |
| 951 | CGAGCCCGGTTAGTA | 1 | 0 | 0 | 0 | 1.02 | 0 | 0 | 0 |
| 952 | CGACTCTTAGCGGTGGA | 0 | 0 | 1 | 0 | 0 | 0 | 1.05 | 0 |
| 953 | CGAATCCCACTTCTGACACCA | 0 | 0 | 0 | 1 | 0 | 0 | 0 | 0.81 |
| 954 | CGAAAGGGAATCGGGTC | 1 | 0 | 0 | 0 | 1.02 | 0 | 0 | 0 |
| 955 | CCTTAGGTCGCTGGTAAA | 0 | 0 | 1 | 0 | 0 | 0 | 1.05 | 0 |
| 956 | CCGTGCGAGAATACCA | 0 | 1 | 0 | 0 | 0 | 0.92 | 0 | 0 |
| 957 | CCGGTCTCTCAAGCGGCC | 1 | 0 | 0 | 0 | 1.02 | 0 | 0 | 0 |
| 958 | CCCGGCCCTCGCGCGTCC | 0 | 1 | 0 | 0 | 0 | 0.92 | 0 | 0 |
| 959 | CCCCGGCATTTCCACCA | 0 | 0 | 1 | 0 | 0 | 0 | 1.05 | 0 |
| 960 | CCCCCCCGGCTCCTCCACCA | 0 | 0 | 0 | 1 | 0 | 0 | 0 | 0.81 |
| 961 | CCCCCCACAACCGCTA | 0 | 1 | 0 | 0 | 0 | 0.92 | 0 | 0 |
| 962 | CCCAAGTATTGACTCACCC | 0 | 1 | 0 | 0 | 0 | 0.92 | 0 | 0 |
| 963 | CCAGTAAGCGCGAGTC | 1 | 0 | 0 | 0 | 1.02 | 0 | 0 | 0 |
| 964 | CCAAAGAAAGCACGTAGAG | 0 | 0 | 0 | 1 | 0 | 0 | 0 | 0.81 |
| 965 | CATGTTTAACGGCCGCGGT | 0 | 0 | 1 | 0 | 0 | 0 | 1.05 | 0 |
| 966 | CAGTTTGTAATTAACCCAA | 0 | 0 | 0 | 1 | 0 | 0 | 0 | 0.81 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 967 | CAGGAACGGCGCACCA | 0 | 0 | 1 | 0 | 0 | 0 | 1.05 | 0 |
| 968 | CAGAACCCTCTAAATCCCC | 0 | 0 | 1 | 0 | 0 | 0 | 1.05 | 0 |
| 969 | CACCCGGCTGTGTGCACATGTGT | 1 | 0 | 0 | 0 | 1.02 | 0 | 0 | 0 |
| 970 | CAATTGGACCAATCTATC | 0 | 0 | 1 | 0 | 0 | 0 | 1.05 | 0 |
| 971 | ATTCCTGTACTGCGATA | 0 | 0 | 0 | 1 | 0 | 0 | 0 | 0.81 |
| 972 | ATCCCTGCGGCGTCTCCA | 0 | 0 | 0 | 1 | 0 | 0 | 0 | 0.81 |
| 973 | ATCCCACCGCTGCCATCA | 0 | 1 | 0 | 0 | 0 | 0.92 | 0 | 0 |
| 974 | AGTCAATAGAAGCCGGCGTA | 0 | 0 | 1 | 0 | 0 | 0 | 1.05 | 0 |
| 975 | AGGTTCGTTTGTAAAAA | 0 | 0 | 0 | 1 | 0 | 0 | 0 | 0.81 |
| 976 | AGGTCCTGGGTTTAAGTGT | 0 | 0 | 0 | 1 | 0 | 0 | 0 | 0.81 |
| 977 | AGGGGGAAGTTCTATAGTC | 0 | 0 | 0 | 1 | 0 | 0 | 0 | 0.81 |
| 978 | AGGCTGTGATGCTCTCNTGAGCCCT | 0 | 0 | 1 | 0 | 0 | 0 | 1.05 | 0 |
| 979 | AGCCCCTCTCCGGCCCTTA | 0 | 1 | 0 | 0 | 0 | 0.92 | 0 | 0 |
| 980 | ACTACCACCTACCTCCC | 1 | 0 | 0 | 0 | 1.02 | 0 | 0 | 0 |
| 981 | ACGCCCTTCCCCCCCTTCTTT | 0 | 0 | 0 | 1 | 0 | 0 | 0 | 0.81 |
| 982 | ACCCCACTCCTGGTGCAC | 1 | 0 | 0 | 0 | 1.02 | 0 | 0 | 0 |
| 983 | ACCACCTGATCCCTTCCC | 1 | 0 | 0 | 0 | 1.02 | 0 | 0 | 0 |
| 984 | ACAGCTAAGCACCCACCA | 0 | 0 | 1 | 0 | 0 | 0 | 1.05 | 0 |
| 985 | ACACATGTTTAACGGCC | 1 | 0 | 0 | 0 | 1.02 | 0 | 0 | 0 |
| 986 | AATTAGGGACCTGTATG | 0 | 0 | 1 | 0 | 0 | 0 | 1.05 | 0 |
| 987 | AATGGCCCATTTGGGCAAACA | 0 | 0 | 0 | 1 | 0 | 0 | 0 | 0.81 |
| 988 | AAAGCGGCTGTGCAAACA | 0 | 0 | 0 | 1 | 0 | 0 | 0 | 0.81 |
| 989 | TCGACTCCTGGCTGGCTCGCCA | 0 | 2 | 2 | 1 | 0 | 1.83 | 2.11 | 0.81 |
| 990 | TCCCCGGCATCTCCACCAA | 0 | 1 | 2 | 0 | 0 | 0.92 | 2.11 | 0 |
| 991 | GCGGTGGATCACTCGGCTCGTGCGT | 0 | 0 | 0 | 3 | 0 | 0 | 0 | 2.44 |
| 992 | CCGGGTGTTGTAGA | 2 | 0 | 0 | 0 | 2.04 | 0 | 0 | 0 |
| 993 | TGTAGCGTGGCCGAGCGGT | 0 | 1 | 0 | 0 | 0 | 0.92 | 0 | 0 |
| 994 | TGGGGCGACCTCGGAGCAG | 0 | 0 | 1 | 0 | 0 | 0 | 1.05 | 0 |
| 995 | TGGCGTCCTAAGCCAGGGATTGTGGGT | 0 | 0 | 0 | 1 | 0 | 0 | 0 | 0.81 |
| 996 | TGGCAGGGGAGATACCATGATTT | 0 | 0 | 1 | 0 | 0 | 0 | 1.05 | 0 |
| 997 | TCTGATCAGGGTGAGCATC | 0 | 1 | 0 | 0 | 0 | 0.92 | 0 | 0 |
| 998 | TCGTAGGCACCATCCAT | 0 | 0 | 0 | 1 | 0 | 0 | 0 | 0.81 |
| 999 | GGGAAACGGGCGCGGCTG | 0 | 1 | 0 | 0 | 0 | 0.92 | 0 | 0 |
| 1000 | CTACTCCTGCTCGCATCTGCTATA | 0 | 0 | 1 | 0 | 0 | 0 | 1.05 | 0 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 1001 | CGGGTGGGTTTTACCGG | 1 | 0 | 0 | 0 | 1.02 | 0 | 0 | 0 |
| 1002 | CGAGGAATTCCCAGTAAG | 0 | 0 | 1 | 0 | 0 | 0 | 1.05 | 0 |
| 1003 | CGAACGCACTTGCGGCCCC | 1 | 0 | 0 | 0 | 1.02 | 0 | 0 | 0 |
| 1004 | CCCCGCGCGGGTTCGAATC | 1 | 0 | 0 | 0 | 1.02 | 0 | 0 | 0 |
| 1005 | AGGGGTATGATTCCCGCTT | 0 | 0 | 0 | 1 | 0 | 0 | 0 | 0.81 |
| 1006 | CGGGGCCACGCGCGCGTC | 3 | 6 | 0 | 0 | 3.06 | 5.5 | 0 | 0 |
| 1007 | TGGCGCTGCGGGATGAAC | 0 | 3 | 1 | 0 | 0 | 2.75 | 1.05 | 0 |
| 1008 | CCCCCCACTGCTAAATTTGACTGGCTT | 0 | 0 | 2 | 2 | 0 | 0 | 2.11 | 1.63 |
| 1009 | TAAAGGTTCGTTTGTAAAA | 0 | 0 | 0 | 3 | 0 | 0 | 0 | 2.44 |
| 1010 | CGGGGCCGAGGGAGCGA | 1 | 2 | 0 | 0 | 1.02 | 1.83 | 0 | 0 |
| 1011 | GGGTTAGGCCTCTTTT | 0 | 1 | 1 | 0 | 0 | 0.92 | 1.05 | 0 |
| 1012 | CTGCGGAAGGATCATTA | 1 | 0 | 1 | 0 | 1.02 | 0 | 1.05 | 0 |
| 1013 | CCCTACCCCCCCGG | 0 | 2 | 0 | 0 | 0 | 1.83 | 0 | 0 |
| 1014 | CCCGCCGGGTCCGCCC | 2 | 0 | 0 | 0 | 2.04 | 0 | 0 | 0 |
| 1015 | CCCCGCGCCCTCTCTCTC | 0 | 2 | 0 | 0 | 0 | 1.83 | 0 | 0 |
| 1016 | CAGGCCTCCCTGGAATC | 2 | 0 | 0 | 0 | 2.04 | 0 | 0 | 0 |
| 1017 | AGTCCCACCCGGGGTACCA | 0 | 0 | 0 | 2 | 0 | 0 | 0 | 1.63 |
| 1018 | TTGACACGCCCAGTGCCCTGT | 1 | 0 | 0 | 0 | 1.02 | 0 | 0 | 0 |
| 1019 | TGGGAGCGGGCGGGCGGTC | 0 | 1 | 0 | 0 | 0 | 0.92 | 0 | 0 |
| 1020 | TGGCGTGGAGCCGGGCGT | 0 | 1 | 0 | 0 | 0 | 0.92 | 0 | 0 |
| 1021 | TGGAGGTCCGTAGCGGT | 1 | 0 | 0 | 0 | 1.02 | 0 | 0 | 0 |
| 1022 | TGAAGAAGGTCTCGAACA | 0 | 0 | 0 | 1 | 0 | 0 | 0 | 0.81 |
| 1023 | TCTCGCCGGGGCTTCCA | 0 | 1 | 0 | 0 | 0 | 0.92 | 0 | 0 |
| 1024 | TCGTAGCACCATCAATAA | 0 | 0 | 0 | 1 | 0 | 0 | 0 | 0.81 |
| 1025 | TCCGGGTCCCCCCTCCA | 0 | 1 | 0 | 0 | 0 | 0.92 | 0 | 0 |
| 1026 | TCCGGGGCTGCACGCGCGCT | 0 | 1 | 0 | 0 | 0 | 0.92 | 0 | 0 |
| 1027 | TCCGGCCGTGTCGGT | 1 | 0 | 0 | 0 | 1.02 | 0 | 0 | 0 |
| 1028 | TCCCTGTCCTCCAGGAGT | 0 | 0 | 0 | 1 | 0 | 0 | 0 | 0.81 |
| 1029 | TCCCCTCCTCGTCGCCA | 1 | 0 | 0 | 0 | 1.02 | 0 | 0 | 0 |
| 1030 | TCCCAGGTAGTCTAGTGGT | 1 | 0 | 0 | 0 | 1.02 | 0 | 0 | 0 |
| 1031 | TATTCATTTATCCCCAGCCTAT | 0 | 1 | 0 | 0 | 0 | 0.92 | 0 | 0 |
| 1032 | TAGTTGTTATAACCCAA | 0 | 0 | 0 | 1 | 0 | 0 | 0 | 0.81 |
| 1033 | TAGATCACCCCCTCCCC | 0 | 1 | 0 | 0 | 0 | 0.92 | 0 | 0 |
| 1034 | TACCGGCACCTGGCGCC | 1 | 0 | 0 | 0 | 1.02 | 0 | 0 | 0 |
| 1035 | GTATAGGGGCGAAAGAC | 0 | 0 | 1 | 0 | 0 | 0 | 1.05 | 0 |
| 1036 | GTAGCTGGTTCCCTCCGAA | 0 | 0 | 0 | 1 | 0 | 0 | 0 | 0.81 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| 1037 | GGTAAGAAGCCCGGCTC | 0 | 0 | 1 | 0 | 0 | 0 | 1.05 | 0 |
| 1038 | GGGGGGGTTTAAAAAAAAA | 0 | 0 | 0 | 1 | 0 | 0 | 0 | 0.81 |
| 1039 | GGGGCGCACTACCGGCC | 1 | 0 | 0 | 0 | 1.02 | 0 | 0 | 0 |
| 1040 | GGGAGAGGCTGTCGCTGCG | 0 | 0 | 0 | 1 | 0 | 0 | 0 | 0.81 |
| 1041 | GGCGGGTGAAGCGGCG | 0 | 1 | 0 | 0 | 0 | 0.92 | 0 | 0 |
| 1042 | GCGGTTCCGGCGGCGTC | 0 | 1 | 0 | 0 | 0 | 0.92 | 0 | 0 |
| 1043 | GCGGGGCGCCTAGGCCTGGTTTGT | 1 | 0 | 0 | 0 | 1.02 | 0 | 0 | 0 |
| 1044 | GCGGCGGTCGGCGGGCGGCGGG | 1 | 0 | 0 | 0 | 1.02 | 0 | 0 | 0 |
| 1045 | GAGGGGGGGGGTGGGGGGGGA | 0 | 0 | 0 | 1 | 0 | 0 | 0 | 0.81 |
| 1046 | CTGTCGGCCACCATCAT | 0 | 0 | 0 | 1 | 0 | 0 | 0 | 0.81 |
| 1047 | CTGCAACTCGACCCCA | 0 | 1 | 0 | 0 | 0 | 0.92 | 0 | 0 |
| 1048 | CTCCTCTCCCCGCCCGCCG | 0 | 0 | 1 | 0 | 0 | 0 | 1.05 | 0 |
| 1049 | CTCAAAGATTAAGCCATGCATGTCTA | 0 | 0 | 1 | 0 | 0 | 0 | 1.05 | 0 |
| 1050 | CTACGCCGCGACGAG | 1 | 0 | 0 | 0 | 1.02 | 0 | 0 | 0 |
| 1051 | CGGGTGACGGGGAATCAGGGTT | 1 | 0 | 0 | 0 | 1.02 | 0 | 0 | 0 |
| 1052 | CGGGCAGCTTCCGGGA | 0 | 0 | 0 | 1 | 0 | 0 | 0 | 0.81 |
| 1053 | CGGGAGGCCCGGGTCCTG | 1 | 0 | 0 | 0 | 1.02 | 0 | 0 | 0 |
| 1054 | CGGCCCCGCATCCTCCC | 1 | 0 | 0 | 0 | 1.02 | 0 | 0 | 0 |
| 1055 | CGCGGGTAAACGGCGGGAGTAACTAT | 0 | 0 | 1 | 0 | 0 | 0 | 1.05 | 0 |
| 1056 | CGCCCCCCGTTCCCCCCTCC | 0 | 1 | 0 | 0 | 0 | 0.92 | 0 | 0 |
| 1057 | CGAGCGGAAACACCA | 1 | 0 | 0 | 0 | 1.02 | 0 | 0 | 0 |
| 1058 | CGAACCCGGCACCGC | 1 | 0 | 0 | 0 | 1.02 | 0 | 0 | 0 |
| 1059 | CCTCGGGCCGATCGCAC | 0 | 0 | 1 | 0 | 0 | 0 | 1.05 | 0 |
| 1060 | CCTATATATCTTACCA | 0 | 1 | 0 | 0 | 0 | 0.92 | 0 | 0 |
| 1061 | CCGTGGCGGCGACGACC | 0 | 1 | 0 | 0 | 0 | 0.92 | 0 | 0 |
| 1062 | CCGGGTTCCGGCACCA | 1 | 0 | 0 | 0 | 1.02 | 0 | 0 | 0 |
| 1063 | CCGCGAGGGGGCCCG | 1 | 0 | 0 | 0 | 1.02 | 0 | 0 | 0 |
| 1064 | CCGCCTCACGGGACCA | 1 | 0 | 0 | 0 | 1.02 | 0 | 0 | 0 |
| 1065 | CCGCCCGTCCCCGCCCCTTG | 0 | 1 | 0 | 0 | 0 | 0.92 | 0 | 0 |
| 1066 | CCCGGGGCCGCGGTTCCG | 1 | 0 | 0 | 0 | 1.02 | 0 | 0 | 0 |
| 1067 | CCCGAGCCGCCTGGAT | 0 | 1 | 0 | 0 | 0 | 0.92 | 0 | 0 |
| 1068 | CCCGACGGCCGAACT | 0 | 1 | 0 | 0 | 0 | 0.92 | 0 | 0 |
| 1069 | CCCCGGGGAGCCCGGCGGG | 1 | 0 | 0 | 0 | 1.02 | 0 | 0 | 0 |
| 1070 | CCCCCTCGCGGCCCTCCCC | 0 | 1 | 0 | 0 | 0 | 0.92 | 0 | 0 |

TABLE 4B-continued

List of short-RNA consensus with maximum 1 mismatch to the human genome. Table includes information on genomic frequencies.

| SEQ ID NO: | Short-RNA sequence | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| 1071 | CCCCCCGTGGCGGCGAC | 0 | 1 | 0 | 0 | 0 | 0.92 | 0 | 0 |
| 1072 | CCACCCAGGGCACGCCA | 1 | 0 | 0 | 0 | 1.02 | 0 | 0 | 0 |
| 1073 | CACGGGTGACGGGGAA | 1 | 0 | 0 | 0 | 1.02 | 0 | 0 | 0 |
| 1074 | ATGGGGAGGAAAAAAAAAAAAA | 0 | 0 | 0 | 1 | 0 | 0 | 0 | 0.81 |
| 1075 | ATCCCACCGCTGCCCCCA | 0 | 0 | 0 | 1 | 0 | 0 | 0 | 0.81 |
| 1076 | ATCACGTCGGTCACCA | 0 | 0 | 0 | 1 | 0 | 0 | 0 | 0.81 |
| 1077 | ACGGGAAACCTCACCCGGCCCGG | 0 | 0 | 1 | 0 | 0 | 0 | 1.05 | 0 |
| 1078 | ACAGAGGCTTACGACCCCTTATTT | 0 | 0 | 1 | 0 | 0 | 0 | 1.05 | 0 |
| 1079 | AAAAAGGCATAATTAAACTT | 0 | 0 | 1 | 0 | 0 | 0 | 1.05 | 0 |

Interestingly, several of these non-annotated sequences (i.e. CU-5004, CU-5021, CU-6030, CU-6069) were cloned multiple times and showed differential expression across libraries, suggesting they may represent short-RNAs with characteristics distinct from those currently recognized in "classic" miRNAs.

In conclusion, the generation of short-RNA libraries from normal and neoplastic B cells led to the identification of 401 bona fide miRNAs as well as other short-RNA species of unknown function.

Abundance and Evolutionary Conservation

Previously reported miRNAs appeared to be more abundant than newly discovered miRNAs (FIG. 13A). Approximately 21% of previously reported miRNAs appeared in the libraries as single occurrences compared to 57% of the newly discovered miRNAs. Approximately 42% of known miRNAs were expressed at all stages of mature B cell development, while newly identified miRNAs showed a more distinct stage-specificity (FIG. 13B), consistent with the notion that presently known miRNAs are mostly representative of ubiquitously expressed miRNAs.

Regardless of their novelty, stage-specific miRNAs were observed with frequencies (defined as the fraction of the total pool of cloned miRNAs represented by a given miRNA) ranging between 0.03 and 0.6% of their respective libraries. The most abundant GC-associated miRNAs showed restricted expression in GC B cells and, if unaffected by transformation, in Ramos cells. However, in naïve and memory B cell libraries only the rarest miRNAs were truly exclusive in their expression and most of the non-GC-specific miRNAs were expressed in both naïve and memory cells albeit at different levels.

Figure 13C:
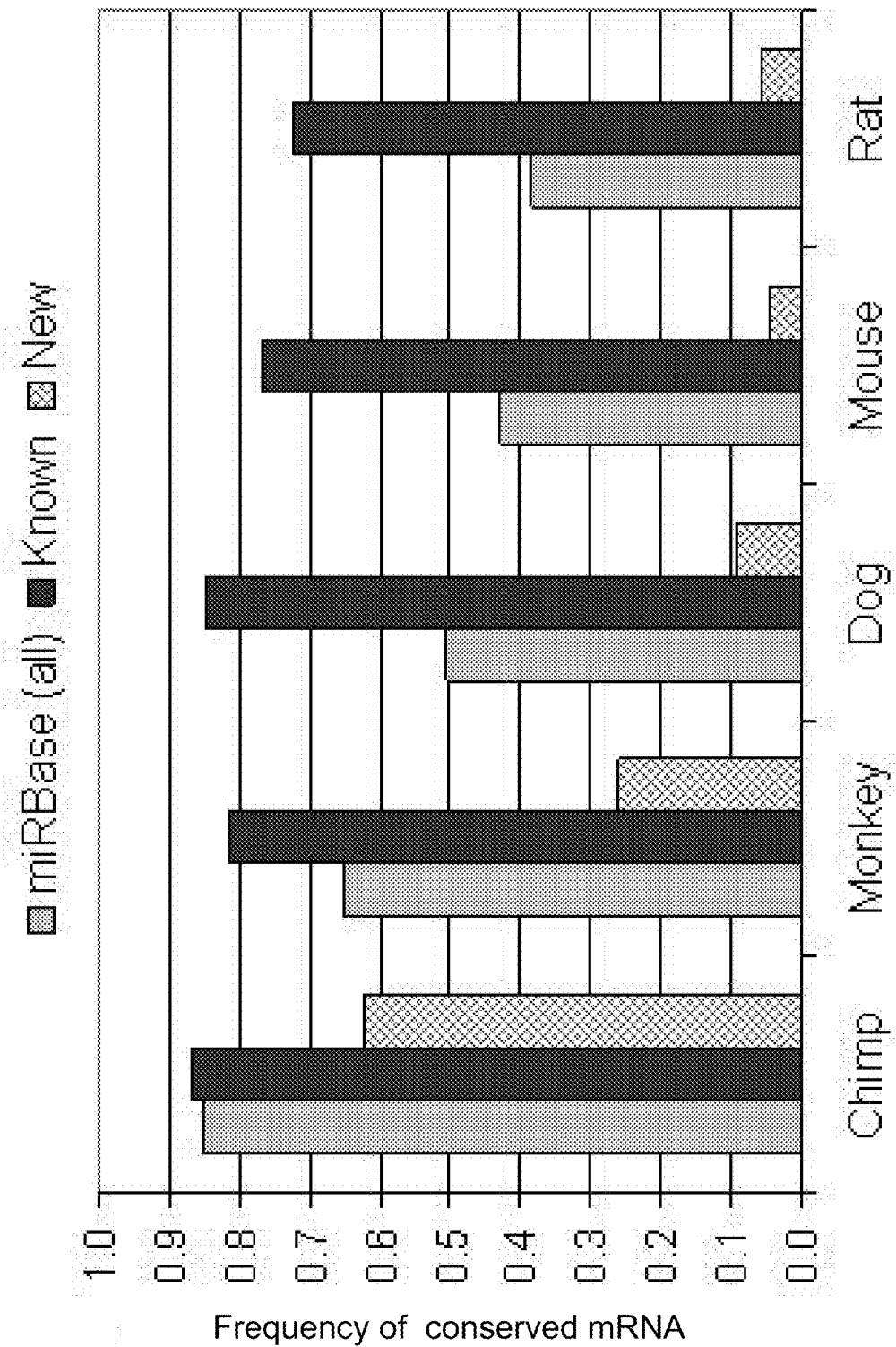
FIG. 13C is a bar graph depicting the conservation analysis for orthologous miRNAs was performed in 5 mammal species for all miRNA reported in the miRBase database (miRBase-all) and for known and new mature miRNA identified in B cell libraries. Frequency of conserved miRNAs in each species is displayed.

In order to investigate the presence of orthologous miRNA in other mammalian species, we relied on UCSC-provided Blastz pairwise alignments between human and target species and investigated conservation using two complementary methods, detailed in Supplementary Methods. The analysis was performed on the complete set of miRNAs deposited in the miRBase database and on the miRNAs (known and new) represented in the B cell libraries. Alignments of the human mature miRNA to its target species were required to have either perfect conservation of the entire mature miRNA sequence (FIG. 13C) or conservation of seeds composed of seven bases starting from the second position of the human mature sequence followed by conservation of 3 bases starting from the 12th, 13th or 14th position as suggested by[21]. The majority of miRBase miRNAs showed conservation across mammalian genomes, from primates to rodents. Conservation frequency mimicked known phylogenetic distances to human, with the highest conservation in chimp and lowest in rat. The conservation frequencies of known and new miRNAs in B cells were similar in chimp (*Pan troglodytes*) and monkey (*Macacus rhesus*), especially when conservation requirements were restricted to the seed region of miRNAs. However, conservation frequencies in dog, mouse and rat were significantly divergent, with known miRNAs more likely to exhibit conservation than new candidate miRNAs (FIG. 13C). In summary, new miRNAs expressed at specific stages of B cell differentiation were less abundant and showed a lower level of conservation across species.

Validation of Newly Discovered miRNA

Figure 14A:
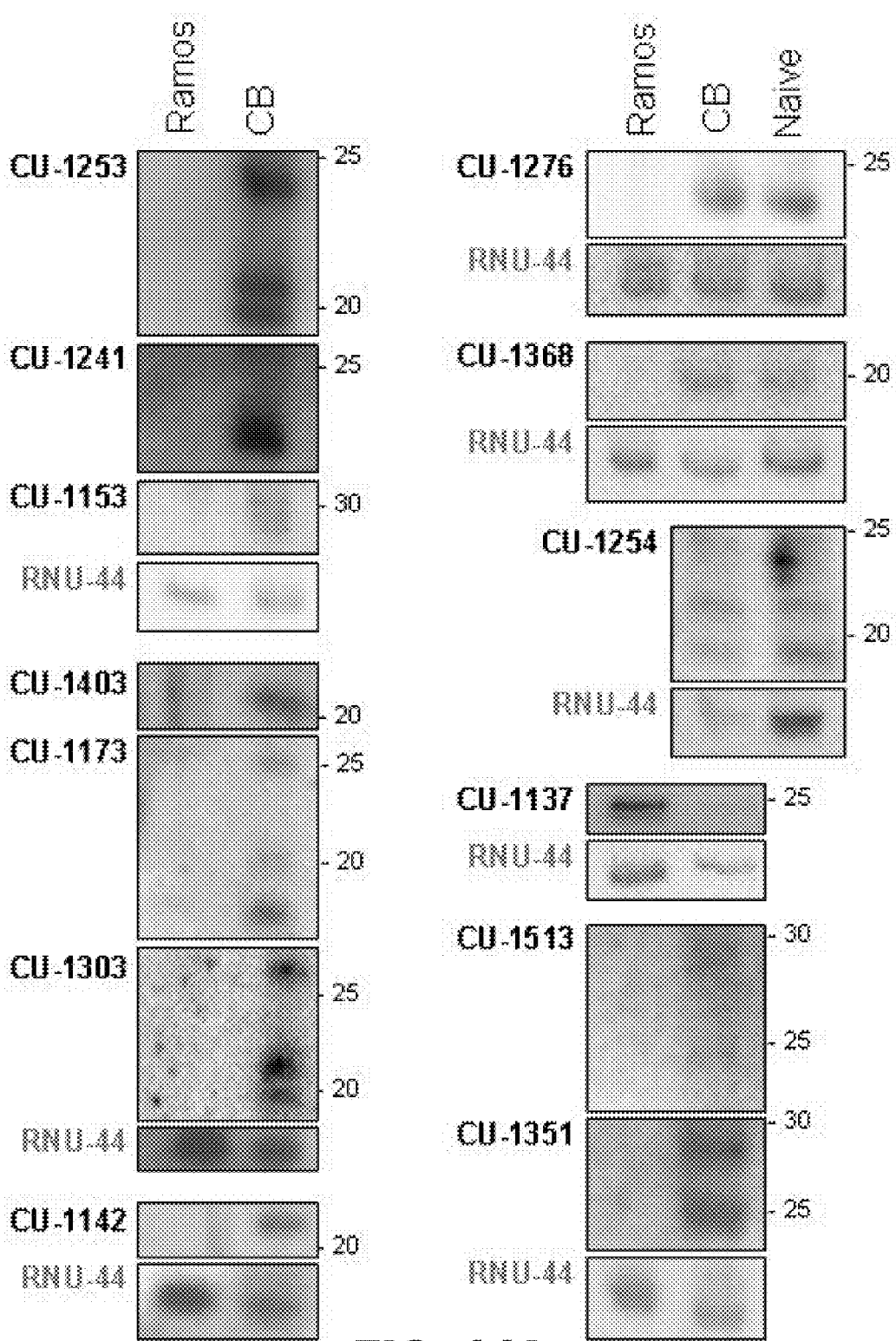
FIG. 14A shows the detection of newly identified mature-miRNA species by Northern Blot in Ramos cell line, centroblasts (CB), and naïve B cells isolated from human tonsils. The naming of miRNA is provisional.

The newly identified miRNAs were investigated by Northern Blot analysis in order to validate their existence in vivo. Northern Blot analyses were performed using B cell lines and cells isolated from tonsil tissue obtained from multiple donors. Among 23 candidate miRNAs that have been cloned in any of the four libraries with 1-100 occurrences, 13 were detectable by Northern Blot (FIG. 14A). Detection of several miRNAs represented by low number of occurrences in the libraries was successful only upon enrichment for the short-RNA fraction, suggesting that low-abundance miRNA could be below the level of detection by Northern blotting. Overall, approximately 55% of the newly cloned and computationally validated miRNAs were detectable by Northern Blot.

Transcriptional and Post-Transcriptional Regulation

Figure 14B:
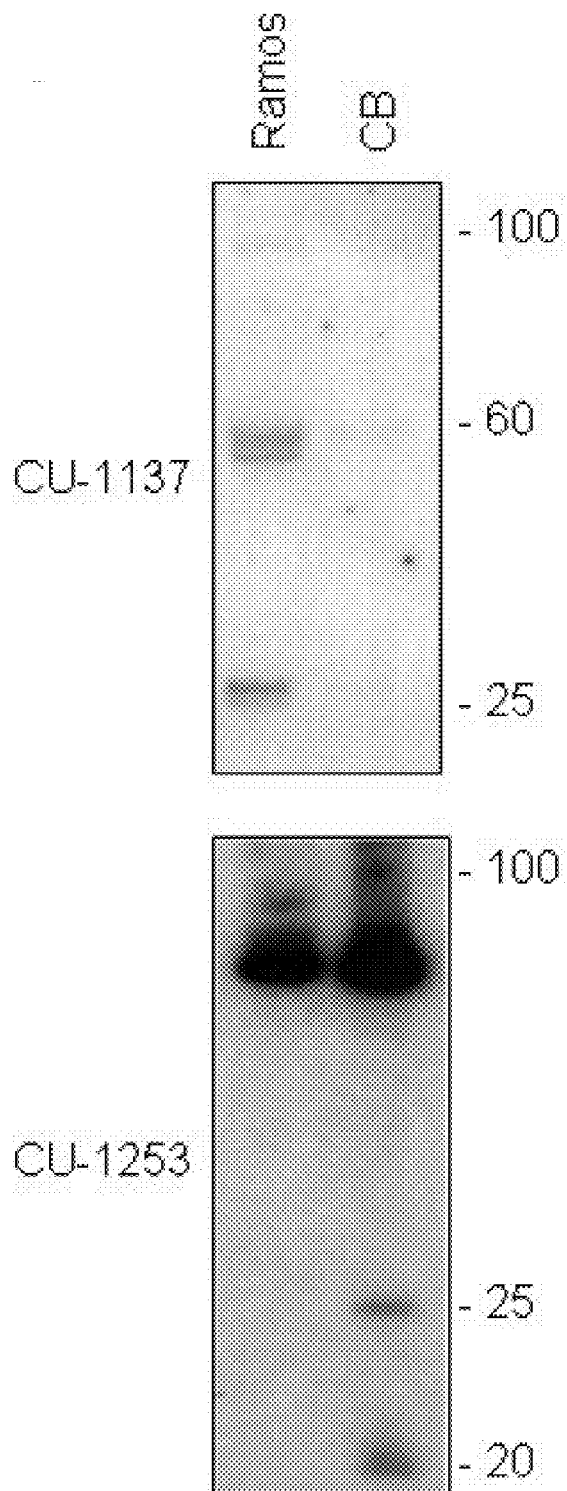
FIG. 14B shows images displaying both the mature (20-25 nt) and the precursor (60-80 nt) miRNA species. miRNA expression can be regulated at transcriptional level (top panel) or at the processing level (bottom panel) when intermediate forms (pre-miRNA) are generated but are not fully processed to mature miRNA.

Most newly identified miRNAs showed a long abundant transcript (>150 nt) that might correspond to the primary miRNA transcript and a second transcript (~60-80 nt) consistent with the precursor miRNA. As shown in FIG. 14B (top panel), the precursor miRNA and the correspondent mature miRNA may be produced in some cell type but not in others, suggesting transcriptional regulation. Conversely in some cases the miRNA precursor species may be present in cell types that lack expression of the mature form (FIG. 14B, bottom panel) suggesting the existence of a second level of regulation targeting the Dicer-dependent pre-miRNA processing[22-24].

Distinct miRNA Signatures in Normal B Cells miRNA representation in the four constructed libraries suggested differential expression of miRNAs during B cell differentiation and GC transit (FIG. 13B). The correlation among miRNA profiles from normal B cells and Ramos cell line was further investigated by hierarchical clustering using miRNA frequencies (defined as the fraction of the total pool of cloned miRNAs represented by a given miRNA in a library) obtained from the cloning data (FIG. 15A). Naïve and memory B cells appeared similar, sharing a large fraction of the most abundant miRNA. Conversely, centroblasts and Ramos cells showed more distinct miRNA profiles with a sizeable fraction of abundant miRNA being specifically expressed in each library.

We also performed miRNA expression profiling of centroblasts, naïve and memory B cells (six donors/each) using a microarray representative of 723 known human miRNAs (miRBase v.10.1). Each B cell population showed a distinct miRNA expression profile. Consistent with the cloning data (FIGS. 13B and 15A) GC B cells appeared to be quite distinct from naïve and memory B cells which instead shared expression of a large fraction of miRNAs (FIG. 15A). The main differences between naïve and memory B cells resided in the level of miRNA expression. The expression of several miRNAs was tested by qRT-PCR analysis which confirmed that the microarray data were accurate for the relative quantification.

miRNA Signatures can Identify Subtypes of B Cell Malignancies

Figure 16:
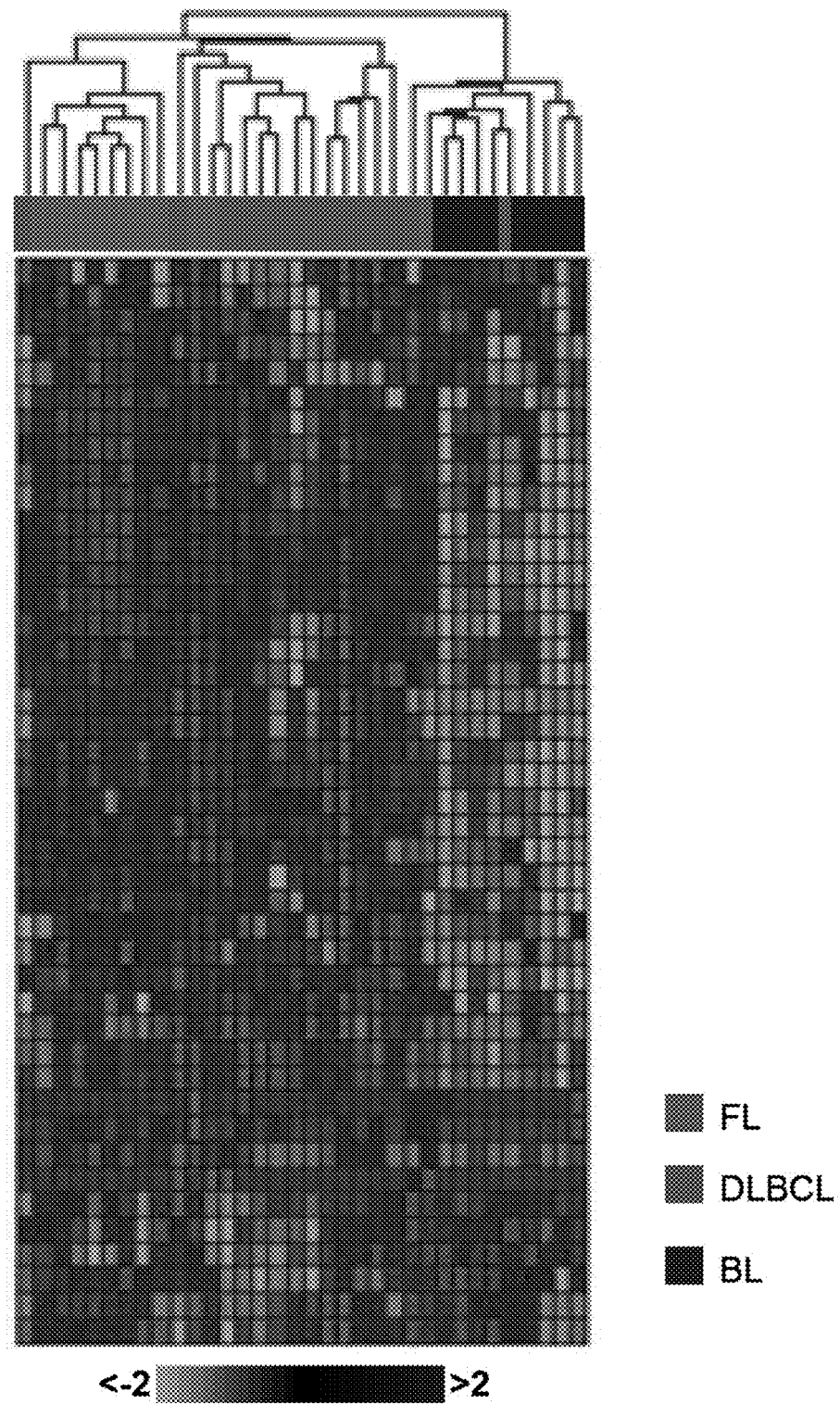
FIG. 16 is an image of a microarray-based miRNA expression profiling of GC-derived lymphomas. Unsupervised clustering of miRNA expression profiles of Burkitt lymphomas (BL), follicular lymphomas (FL) and diffuse large B cell lymphomas (DLBCL).

The miRNA library generated from Ramos BL cell line demonstrated that tumors can display specific miRNA expression signatures. To investigate whether these signatures can identify subtypes of B cell malignancies, miRNA expression profiling was performed using the same microarray platform on a panel of GC-derived malignancies including BL (8), DLBCL (16) and FL (10). Unsupervised clustering analysis of the tumor miRNA profiles was able to identify three major clusters enriched for samples belonging to each malignant phenotype (FIG. 16). These tumors can be discriminated as well by gene expression profiling however it requires the use of a higher number of features. These results show that tumors deriving from the same stage of B cell differentiation acquire distinct miRNA expression profiles as consequence of malignant transformation.

Discussion

The combination of cloning procedures and computational tools led us to the identification of a large fraction of known as well as newly discovered miRNA expressed during B cell differentiation. These findings have general implications for the understanding of the total miRNA content of the human genome as well as for future studies on the role of miRNAs in B cell differentiation, function and lymphomagenesis.

The discovery of >250 new miRNAs and of their tissue-specific pattern of expression are in sharp contrast with previous reports that suggested, based on the discovery of only 12 new human miRNA[7] from an analysis of 26 different organ systems and cell types, that most miRNAs are ubiquitously expressed and that most miRNAs have already been identified. These discordant results and conclusions may be partially due to the significantly higher number of clones per library sequenced in this study (3500 versus 1300 on average in[7]) which allowed the detection of low abundant miRNA species and to the criteria applied in the miRNA prediction (see Supplementary Methods).

The relatively lower degree of evolutionary conservation of tissue-specific miRNAs (FIG. 13C) may have prevented the cross-species identification of miRNAs using murine libraries[18,25]. Consistent with these observations, a recent report on short-RNAs in mouse embryonic stem cells discovered new Dicer-dependent miRNAs characterized by both low abundance and low level of conservation[26]. Thus, a large number of low-abundance, recently evolved, tissue-specific miRNAs remain to be discovered.

Two categories of short-RNAs were identified that could not be annotated as bona fide miRNAs. The first category is represented by those short-RNAs that could not be accurately mapped to the genome. Considering that a fraction of these RNAs were cloned multiple times and showed a stage-specific behavior, such short-RNAs do actually exist and that the lack of a match to the human genome may be due to polymorphisms, editing and other post-transcriptional modifications or to an incomplete/inaccurate sequencing of the corresponding genomic regions. The second category is represented by short-RNAs for which classic pre-miRNA structures could not be identified in the genome and no similarity to other non-coding RNA was found in the available databases. These short-RNAs may either be miRNA for which RNA secondary structure prediction algorithms failed to predict the correct hairpin structure or may represent new miRNA species of presently unknown mechanism of generation or other not yet described types of short-RNAs.

The stage specific expression of various miRNAs, especially in GC B cells, suggests highly specialized regulatory functions in B cell biology. The role of miRNAs that show cell type-specific functions in lymphocytes has just begun to be elucidated[8-10,27]. The miRNAs specifically associated to GC or non-GC B cells by either cloning or miRNA expression profiling (FIG. 15) have not been previously reported in B cell differentiation with the exception of miR-150[10]. The miR-17-92 cluster, previously reported as a potential oncogene[11], was found over-expressed in Ramos cell line compared to GC B cells possibly as a consequence of the transformation process.

Specificity in mature miRNA expression may be regulated at the transcriptional as well as at the post-transcriptional, i.e. pre-miRNA processing, level. Pre-miRNA accumulation in absence of a mature miRNA can occur in a cell type-restricted manner, suggesting the presence of a regulation mechanism at the pre-miRNA processing step. Both regulatory mechanisms may act during normal differentiation and may also be dysregulated during transformation as a consequence of genetic or epigenetic alterations[22-24]. The expanded B cell miRNome described here can be used to identify specific differences in miRNA expression in normal versus lymphoma cells that can guide searches for these tumor alterations.

miRNA expression profile differences between GC and non-GC B cells resembled those observed by expression profiling of coding genes[28], consistent with the previous observation that miRNA profiling may be equally or more informative in discriminating cell phenotypes[29]. miRNA expression profiling, especially if including new B-cell specific miRNAs, may be useful in the differential diagnosis of lymphoid malignancies.

Materials and Methods

Generation of Short-RNA Libraries

Purification of naïve, memory and GC B cells was performed as previously reported[28] using magnetic cell sorting of mononucleated cells obtained from human tonsils. Total RNA was purified using the Trizol Reagent (Invitrogen) following the manufacturer's indications. The short-RNA libraries were generated using an established protocol described in detail in[30]. Briefly, total RNA was separated on 15% polyacrylamide gel and the fragment corresponding to 18-28 nucleotides length was excised. The purified small RNAs were linked to adaptor oligonucleotides and gel purified. Upon adaptor ligation, RNA was reverse transcribed and cDNA was PCR amplified and cloned into pCR2.1-TOPO vector (Invitrogen). Sequencing was performed on colony PCR amplicons.

Computational Identification of Mature and Precursor MiRNAs

The bioinformatics miRNA analysis pipeline (FIG. 18) includes: (a) identification of short-RNAs from each library, (b) identification of exact and partial matches of the short-RNA sequences to the human genome, (c) testing each short-RNA genomic region for compatibility with hairpin secondary structures, (d) clustering genomic regions to predict mature miRNAs, (e) annotating and filtering short-RNAs and miRNAs candidates, (f) estimation of predicted miRNA frequencies in the libraries and (g) clustering short-RNAs that do not support miRNA candidates. The details are reported in the Supplementary Methods.

Orthology Analysis

The identification of putative orthologous sequences of known and predicted precursor and mature human miRNAs in chimp (panTro2), monkey (rheMac2), dog (canFam2) mouse (mm8) and rat (rn4) was performed using UCSC-provided Blastz[31] pairwise alignments between human and target species. The details are reported in the Supplementary Methods.

miRNA Expression Profiling

The miRNA expression profiles were generated using the Human miRNA Microarray kit (Agilent Technologies) that allows detection of 723 known human (miRBase v.10.1) and 76 human viral miRNAs following the manufacturer's indications. Analysis of raw data was performed using the Feature Extraction Software 9.5.3.1 (Agilent Technologies). The dendrograms (FIG. 15) were generated using a hierarchical clustering algorithm based on the average-linkage method[32,33] and Spearman's correlation as provided by the geWorkbench platform (http://www.geworkbench.org).

Northern Blot

Total RNA and small RNA fractions were purified using the Trizol Reagent (Invitrogen) and the PureLink miRNA Isolation Kit (Invitrogen), respectively, following the manufacturer's indications. Electrophoresis was performed on 15% denaturing polyacrylamide gel and then RNA was transferred on Duralon UV membrane (Stratagene) using a semi-dry transfer apparatus. Pre-hybridization and hybridization were performed in 5×SSC, 20 mM $Na_2HPO_4$ pH 7.2, 7% SDS, 3×Denhardt's Solution. Oligonucleotide probes were [$\gamma^{32}$P]-ATP labeled by polynucleotide kinase (Fermentas). The list of oligonucleotides is reported in Table 5.

TABLE 5

Listing of Oligonucleotide Probe Sequences

| ID | Mature miRNA sequence (5'-3') | SEQ ID NO: | Probe sequence (5'-3') | SEQ ID NO: |
|---|---|---|---|---|
| CU-1303 | ATCCCACTTCTGACACCA | 237 | TGGTGTCAGAAGTGGGAT | 1080 |
| CU-1403 | GCATTGGTGGTTCAGTGGTAGA | 391 | TCTACCACTGAACCACCAATGC | 1081 |
| CU-1253 | GTGAAGCGTTCCATATTTTT | 281 | AAAAATATGGAACGCTTCAC | 1082 |
| CU-1513 | GCGGGTGATGCGAACTGGAGTCTGAGC | 381 | GCTCAGACTCCAGTTCGCATCACCCGC | 1083 |
| CU-1173 | ATCCCACTCCTGACACCA | 145 | TGGTGTCAGGAGTGGGAT | 1084 |
| CU-1276 | TCGATTCCCGGCCAATGCACCA | 236 | TGGTGCATTGGCCGGGAATCGA | 1085 |
| CU-1368 | GACGAGGTGGCCGAGTGG | 382 | AACCACTCGGCCACCTCGTC | 1086 |
| CU-1254 | TCCCCGGCACCTCCACCA | 233 | TGGTGGAGGTGCCGGGGA | 1087 |
| CU-1137 | GCTAAGGAAGTCCTGTGCTCAGTTTT | 132 | AAAACTGAGCACAGGACTTCCTTAGC | 1088 |
| CU-1153 | CCCCCCACTGCTAAATTTGACTGGCTT | 142 | AAGCCAGTCAAATTTAGCAGTGGGGGG | 1089 |
| CU-1241 | AGTCCCATCTGGGTCGCCA | 243 | TGGCGACCCAGATGGGACT | 1090 |
| CU-1351 | CCTTCCTTGGATGTCTGAGTGAG | 316 | CTCACTCAGACATCCAAGGAAGG | 1091 |
| CU-1142 | TCGATTCCCGGCCCATGCACCA | 149 | TGGTGCATGGGCCGGGAATCGA | 1092 |

After over-night hybridization, membranes were washed at the same temperature in 3×SSC, 25 mM $NaH_2PO_4$ pH 7.5, 5% SDS, 10×Denhardt's Solution for 15-20' and in 1×SSC, 1% SDS for 5'. Images were obtained by exposure to phosphoimager cassette and acquisition by Storm 840 Phosphoimager (Molecular Dynamics) and by film exposure for approximately 2 weeks.

REFERENCES

1. Bartel, D. P. MicroRNAs: genomics, biogenesis, mechanism, and function. *Cell* 116, 281-97 (2004).
2. Kim, V. N. MicroRNA biogenesis: coordinated cropping and dicing. *Nat Rev Mol Cell Biol* 6, 376-85 (2005).
3. Griffiths-Jones, S. miRBase: the microRNA sequence database. *Methods Mol Biol* 342, 129-38 (2006).
4. Griffiths-Jones, S., Grocock, R. J., van Dongen, S., Bateman, A. & Enright, A. J. miRBase: microRNA sequences, targets and gene nomenclature. *Nucleic Acids Res* 34, D140-4 (2006).
5. Miranda, K. C. et al. A pattern-based method for the identification of MicroRNA binding sites and their corresponding heteroduplexes. *Cell* 126, 1203-17 (2006).
6. Bentwich, I. et al. Identification of hundreds of conserved and nonconserved human microRNAs. *Nat Genet*. 37, 766-70 (2005).
7. Landgraf, P. et al. A mammalian microRNA expression atlas based on small RNA library sequencing. *Cell* 129, 1401-14 (2007).
8. That, T. H. et al. Regulation of the germinal center response by microRNA-155. *Science* 316, 604-8 (2007).
9. Rodriguez, A. et al. Requirement of bic/microRNA-155 for normal immune function. *Science* 316, 608-11 (2007).
10. Xiao, C. et al. MiR-150 Controls B Cell Differentiation by Targeting the Transcription Factor c-Myb. *Cell* 131, 146-59 (2007).
11. He, L. et al. A microRNA polycistron as a potential human oncogene. *Nature* 435, 828-33 (2005).
12. Calin, G. A. et al. Frequent deletions and down-regulation of micro-RNA genes miR15 and miR16 at 13q14 in chronic lymphocytic leukemia. *Proc Nail Acad Sci USA* 99, 15524-9 (2002).
13. Calin, G. A. et al. A MicroRNA signature associated with prognosis and progression in chronic lymphocytic leukemia. *N Engl J Med* 353, 1793-801 (2005).
14. Kuppers, R. & Dalla-Favera, R. Mechanisms of chromosomal translocations in B cell lymphomas. *Oncogene* 20, 5580-94 (2001).
15. Klein, U. & Dalla-Favera, R. Germinal centres: role in B-cell physiology and malignancy. *Nat Rev Immunol* 8, 22-33 (2008).
16. Harrell, F. E. *Regression modeling strategies: with applications to linear models, logistic regression, and survival analysis* (Springer, N.Y., 2001).
17. Hinkley, A. C. D. a. D. V. *Bootstrap Methods and their Applications* (Cambridge University Press, New York, 1997).
18. Neilson, J. R., Zheng, G. X., Burge, C. B. & Sharp, P. A. Dynamic regulation of miRNA expression in ordered stages of cellular development. *Genes Dev* 21, 578-89 (2007).
19. Kawahara, Y. et al. Redirection of silencing targets by adenosine-to-inosine editing of miRNAs. *Science* 315, 1137-40 (2007).
20. Luciano, D. J., Mirsky, H., Vendetti, N. J. & Maas, S. RNA editing of a miRNA precursor. *Rna* 10, 1174-7 (2004).
21. Grimson, A. et al. MicroRNA targeting specificity in mammals: determinants beyond seed pairing. *Mol Cell* 27, 91-105 (2007).
22. Thomson, J. M. et al. Extensive post-transcriptional regulation of microRNAs and its implications for cancer. *Genes Dev* 20, 2202-7 (2006).
23. Michael, M. Z., S M, O. C., van Holst Pellekaan, N. G., Young, G. P. & James, R. J. Reduced accumulation of specific microRNAs in colorectal neoplasia. *Mol Cancer Res* 1, 882-91 (2003).
24. Lee, E. J. et al. Systematic evaluation of microRNA processing patterns in tissues, cell lines, and tumors. *Rna* 14, 35-42 (2007).
25. Chen, C. Z., Li, L., Lodish, H. F. & Bartel, D. P. MicroRNAs modulate hematopoietic lineage differentiation. *Science* 303, 83-6 (2004).
26. Calabrese, J. M., Seila, A. C., Yeo, G. W. & Sharp, P. A. RNA sequence analysis defines Dicer's role in mouse embryonic stem cells. *Proc Natl Acad Sci USA* 104, 18097-102 (2007).
27. Li, Q. J. et al. miR-181a is an intrinsic modulator of T cell sensitivity and selection. *Cell* 129, 147-61 (2007).
28. Klein, U. et al. Transcriptional analysis of the B cell germinal center reaction. *Proc Natl Acad Sci USA* 100, 2639-44 (2003).
29. Lu, J. et al. MicroRNA expression profiles classify human cancers. *Nature* 435, 834-8 (2005).
30. Lau, N. C., Lim, L. P., Weinstein, E. G. & Bartel, D. P. An abundant class of tiny RNAs with probable regulatory roles in *Caenorhabditis elegans*. *Science* 294, 858-62 (2001).
31. Schwartz, S. et al. Human-mouse alignments with BLASTZ. *Genome Res* 13, 103-7 (2003).
32. Eisen, M. B., Spellman, P. T., Brown, P. O. & Botstein, D. Cluster analysis and display of genome-wide expression patterns. *Proc Natl Acad Sci USA* 95, 14863-8 (1998).
33. Hartigan, J. A. *Clustering Algorithms* (Wiley, New York, 1975).

Supplementary Methods

Bioinformatics Analysis of Short-RNA Libraries

The bioinformatics microRNA (miRNA) analysis pipeline includes (a) identification of short-RNAs from each library, (b) identification of exact and partial matches of the short-RNA sequences to the human genome, (c) testing each short-RNA genomic region for compatibility with hairpin secondary structures, (d) clustering genomic regions to predict mature miRNAs, (e) annotating and filtering short-RNAs and miRNAs candidates, (f) estimation of predicted miRNA frequencies in the libraries, (g) clustering short-RNAs that do not support miRNAs candidates.

a. Identification of Short-RNAs from Cloned cDNA Sequences:

Short-RNA sequences of length 15-30 bp were recovered from within cloned cDNA sequences using 8 bp adaptor oligonucleotides as oriented markers. An exact ≥6 bp match to the suffix of the 5' daptor oligonucleotide and the prefix of the 3' adaptor oligonucleotide were required. All short-RNAs of length 17 to 27 nt (length range of miRNAs deposited in the miRBase database v11.0) that are bounded by adaptors were reported, and short-RNAs containing adaptor fragments were tagged as lower confidence observations. miRNA candidates supported by low confidence short-RNAs were later evaluated individually and discarded by expert decision. The remaining ones are listed here: CU-1153 is supported by 29 short-RNAs including 1 low confidence; CU-1293 and CU-1079 are supported by low confidence short-RNAs including sequence fragments that could not originate from linkers.

b. Mapping to the Human Genome:

Each short-RNA was aligned to the human genome assembly from March 2006 (hg18) using WU-Blast. WU-Blast was ran locally optimal, with default word length 6, maximum allowed separation 2, no gaps, and no high scoring pair consistency. All WU-Blast reported matches were retrieved and mismatches marked. Only the genomic matches with the smallest number of mismatches were recorded, and we refer to them as short-RNA genomic locations.

c. Testing Short-RNA Genomic Locations for Hairpin Secondary Structures:

Short-RNA genomic locations were tested for compatibility with hairpin secondary structures. The criteria were established upon investigation of the characteristics of mammalian miRNA precursors deposited in the miRBase database (v.11.0)[s1,s2]. Only short-RNAs that have genomic locations compatible with a hairpin structure were used to define putative miRNAs and their precursors. A short-RNA genomic location was considered if the following criteria were satisfied: i) one or more hairpin structures were predicted in the genomic region starting at most 90 bases upstream and ending at most 90 bases downstream of the short-RNA genomic location; ii) the lowest free-energy predicted secondary structure for the containing region was a hairpin with maximum fold free energy of −8 joules, which is the maximum fold free energy observed for miRBase miRNAs; 110 the short-RNA genomic location could not overlap the predicted hairpin loop, which was required to be 3-20 bp long (the range of hairpin-loop lengths observed in the miRBase database); iv) the ratio between the number of complementary base pairs and the total number of base pairs in the stem was larger than 0.645, which is the minimum ratio observed in miRBase database. We used RNAfold 1.6, a part of the ViennaRNA package (http://www.tbi.univie.ac.at/~ivo/RNA/), with temperature set to 37° C. to predict the lowest energy secondary RNA structure for each candidate genomic sequence.

d. Prediction of Mature miRNA:

Short-RNA genomic locations consistent with hairpin secondary structures (smirREGs) were clustered based on genomic region overlap, and smirREG clusters were pruned, split, merged, accepted, or eliminated iteratively. Clusters were first constructed from smirREGs corresponding to: (1) regions perfectly aligned to short-RNAs; (2) regions aligned to short-RNAs with 1-mismatch, represented by an 'A' in the last position; and (3) regions aligned to short-RNAs with 1-mismatch, where the associated short-RNAs had no perfect matches, were not used in (1) or (2) and were 1-mismatch away from short RNAs associated with smirREGs defined in (1) or (2). These smirREGs are major contributors to each region cluster. Regions associated with perfectly matching short-RNAs and 1-mismatch short-RNAs that were not used to define smirREG clusters, but overlapped 5 or fewer such clusters were tagged as minor contributors and added to the overlapping smirREG clusters. Each cluster was pruned or divided by identifying regions corresponding to short-RNAs where more than 25% of the region is supported by no more than 50% of the observations. For each cluster, all such regions were identified and first minor then major contributors with the largest ratio of unsupported portions to total length were iteratively removed until at least 75% of every contributing region was supported by more than 50% of the observations.

One exception is represented by CU-1088 cluster where a short-RNA was included despite the fact that only 70% of its sequence contributed to the majority observation. This exception was made because this short-RNA was the only one matching a known mature miRNA (miR-320a) and it was left out by the 75% rule.

Pruned smirREGs were merged and used to construct new and possibly overlapping clusters, but minor contributors were discarded. Finally, smirREG clusters were used to define putative mature miRNAs. The mature sequence was defined as the majority nucleotide in each position supported by more than 50% of the observations, with the genomic sequence allowed to break ties. SmirREG clusters were matched based on mature sequence containment. Clusters corresponding to a short-RNA set that is fully contained in a set corresponding to a matched cluster were eliminated, and matching clusters with partial containment were merged. The process was repeated until no elimination or merging was needed. Finally, a putative precursor was identified for each smirREG cluster following the procedure described in (c) with the added restriction that no more than 5 positions in the mature sequence were allowed to dangle off of the precursor region encapsulated by complimentary base pairs. When the mature region dangled off of the precursor region (but no more than 5 bases), the precursor was extended with non complimentary bases to include the mature region.

The mature miRNA prediction was followed by the elimination of incompatible predictions. Putative miRNAs whose predicted locations overlapped loops of known miRNAs or precursors of other higher-confidence predictions that could not form mature-star pairs were eliminated. Predicted miRNAs that were entirely composed of low confidence single-observation short-RNAs that contained linker fragments were also eliminated, with the exception of CU-1293 as described in (a). Mature miRNA predictions of length shorter than 17 nt or longer than 28 nt were discarded. Candidate miRNAs that were supported by a single observation were tagged as lower confidence predictions; some of these are likely to be miRNA, but others may be degradation products of previously unannotated RNA.

e. Annotation and Filtering of Candidate miRNA and sRNA:

Putative miRNAs and short RNAs were matched to several RNA databases (see below) via regular expression scans (for sequence databases) or genomic region containment (for databases that specify genomic regions). Databases identifying validated human mRNA, tRNA, snoRNA and yRNA were used to eliminate putative miRNA candidates with one observation and to annotate putative miRNAs with multiple observations. All putative miRNAs matching rRNAs were eliminated regardless of the number of observations because of the extreme abundance of rRNAs. Other RNA databases were used for annotation purposes only.

Precursor and mature miRNA as well as sRNA sequences were aligned to several sequence databases (see below) using the BLAST and MEGABLAST programs from NCBI. Candidate miRNA precursors showing a full match to non-coding RNAs (tRNA, rRNA, snoRNA, other nc-RNA) or to mRNA were disregarded. Predicted precursor and mature miRNAs were further classified as either "known" or "new" based on whether exact matches can be found in miRBAse database. Short-RNA sequences included in miRNA precursor, but not overlapping the mature miRNA, were considered as degradation products of miRNA precursor processing and marked as "miRNA other" (Table 6). All cloned short-RNA were annotated using the databases reported below and results are showed in Table 2.

TABLE 6

Databases used for annotation of short-RNA and miRNA.

| Name/Description | Source | Version/Date |
|---|---|---|
| miRBASE | Sanger Institute, http://microrna.sanger.ac.uk/sequences | version 11.0 |
| Human fraction of REPBASE | GIRI, http://www.girinst.org/Repbase_Update.html | version 12.02 |
| Human tRNA | EMBL, http://www.trna.uni-bayreuth.de, Bayreuth Univ., Germany | September 2007 edition |
| Human snoRNA | The University of Queensland, Australia, IMB, http://imb.uq.edu.au | September 2006 edition |
| Human rRNA | NCBI, ftp://ftp.ncbi.nlm/nih.gov, compiled manually | Downloaded January 2007 |
| Human yRNA | NCBI, ftp://ftp.ncbi.nlm/nih.gov, compiled manually | Downloaded January 2007 |
| Non coding RNA | Compiled manually combining resources from NCBI, ftp://ftp.ncbi.nlm/nih.gov and IMB http://imb.uq.edu.au | Compiled in October 2006 using current ENTREZ and September 2006 edition of Univ. of Queensland database |
| VECTOR databases | NCBI, ftp://ftp.ncbi.nlm/nih.gov | Downloaded January 2007 |
| Human protein coding genes and mRNA | NCBI annotation for human genome, ftp://ftp.ncbi.nlm/nih.gov | Downloaded January 2007 |
| mRNA dataset | NCBI, ftp://ftp.ncbi.nlm/nih.gov compiled manually using ENTRES NR database | Downloaded January 2007 |
| exEID (exon subset of BID database) | University of Toledo, Ohio, http://hsc.utoledo.edu/bioinfo/eid/ | September 2005 (hs35p1) |
| Human mitochondrial genome | NCBI, ftp://ftp.ncbi.nlm/nih.gov | Downloaded January 2007 |
| Human EST database | NCBI, ftp://ftp.ncbi.nlm/nih.gov | |
| Human viral genomes | NCBI, http://www.ncbi.nlm.nih.gov, viral genomes section | Compiled in March 2007 |
| E. coli genomes | NCBI, ftp://ftp.ncbi.nlm/nih.gov | Downloaded August 2007 |
| RefGene Intron | UCSC, http://genome.ucsc.edu, annotation track for hg18 | annotation track for hg18 |
| RefGene Exon | UCSC, http://genome.ucsc.edu, annotation track for hg18 | annotation track for hg18 |
| rnaGenes | UCSC, http://genome.ucsc.edu, annotation track for hg18 | annotation track for hg18 |
| wgRNA | UCSC, http://genome.ucsc.edu, annotation track for hg18 | annotation track for hg18 |
| snoRNA database | EMBL, http://www-snorna.biotoul.fr/ | Version 3 |
| Genscan | MIT, http://genes.mit.edu/GENSCAN.html | Version 1.0 |
| Computational tRNA prdiction | UCSC, http://genome.ucsc.edu, annotation track for hg18 | annotation track for hg18 |
| piRNA | The University of Queensland, Australia, IMB, http://imb.uq.edu.au | September 2006 edition |
| Morozov database | Manually curated | Version 1.0 | f. Estimation of Mature miRNA Frequencies:

Short-RNAs may contribute to more than one miRNA. In order to compare observation frequencies of predicted miRNAs we normalized the contribution of each supporting short-RNA to its associated predicted miRNA in each library. Short-RNAs supporting a single miRNA prediction were not affected, but the level of support of short-RNAs associated with several miRNAs was prorated. The normalization procedure was performed iteratively. First, for each library, we assigned an observation frequency to each miRNA, taken to be the sum of the library-specific observations across all of its supporting short-RNAs. Second, for each short-RNA observed in this library, we computed sum, the sum of the observation frequencies of the predicted miRNAs it supports. Then, short-RNA support for each miRNA was adjusted to be the number of its observations multiplied by the ratio between the observation frequency of this miRNA and sum. Finally, the frequency of each predicted miRNA was recalculated to be the sum of the adjusted frequencies of the short-RNAs supporting it. To compare the abundance of predicted miRNAs across libraries we normalized the frequencies of observations in each library to sum to 100%, comparing frequencies of observations in each library rather than raw observations. This normalization step was necessary due to the variability between the total number of observations across libraries.

g. Clustering Short-RNAs.

Short-RNAs that did not support predicted miRNAs were categorized according to the quality of their best alignments to hg18. These short-RNA were clustered following the procedure described in (c) but with no secondary structure requirements (Table 2 and Tables 9-10). Table 3 and Tables 9-10 were constructed from perfect matches and single mismatches, respectively, as described in (c). Tables 4 and 5 smirREGs were constructed from single-mismatches, double mismatches and three or more mismatches, respectively.

Estimation of Libraries Complexity

A bootstrap technique was used to estimate the total number of miRNAs expressed in each library and the number of short-RNAs must be sequenced to achieve a complete coverage. Bootstrapping is a statistical technique for estimating properties of an "estimator" by measuring those properties in multiple subsets of the samples[s3,s4]. Specifically, we estimated the distribution of mature miRNAs obtained by random sub-sampling different size short-RNA libraries from each complete library. For each size N=10, 20, ... $N_t$, where $N_t$ is the total number of short-RNAs in the library, we randomly sampled 1000 libraries of size N and computed the number r(N) of inferred miRNAs, resulting in a distribution p(r(N)) for which we could compute standard statistical parameters such as average, variance, mode and median. Based on this sampling, we can extrapolate p(r(N)) for increasing values of N to determine at which point it is no longer efficient to use larger values of N to increase miRNA coverage. To achieve this, we fitted the data to the parametric function $f(x)=K*(1-e^{-mx})$. Since we include both experimentally confirmed and putative mature miRNAs and since bootstrapping can produce optimistic results we expect that the estimated values constitute an upper boundary on the real library complexity.

Figure 17:
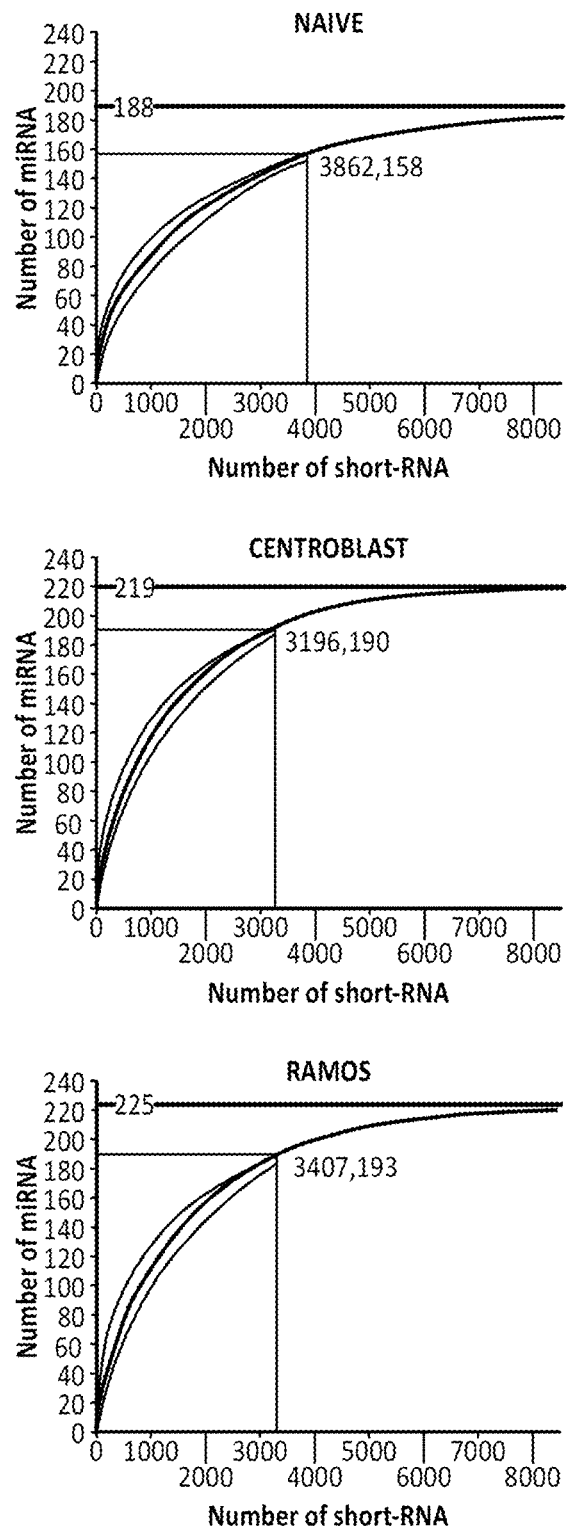
FIG. 17 are graphs demonstrating the complexity of librarries. The curves represent the estimation of the numbers of mature miRNA expressed in each library. Discarding outliers (extreme 5%), the lowest and highest miRNA counts observed per library sample are plotted. The current set of predicted mature miRNAs represents more than 80% of the estimated miRNA set expressed in the libraries.
Figure 17:
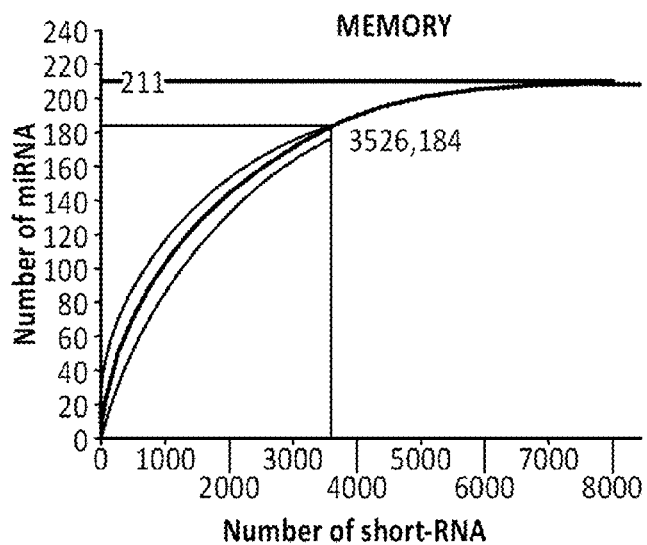

Based on this analysis, we estimated that the total numbers of mature miRNAs are: 188 (naïve), 211 (memory), 219 (centroblasts) and 225 (Ramos). Thus, the libraries sequenced in this study cover respectively 84.0% (naïve), 87.2% (memory), 86.8% (centroblasts), and 85.8% (Ramos) of the expressed miRNAs in these cellular phenotypes. FIG. 17 gives the 95% confidence intervals for p(r(N)) at each sampling point, in addition to the curve of the associated extrapolated function for each library. Clearly, the bootstrap analysis estimate of the total number of miRNA is correct only if the abundance of the miRNAs expressed in the sampled populations closely matches that of known miRNA in miRBase. This is not unreasonable if, as was done here, only miRNAs that are specific to a B cell differentiation stage or transformation are considered. Thus, this does not estimate the total number of miRNA expressed across all human cell types, stages of differentiation and neoplastic transformations, which could be several fold larger than what was estimated from the B cell clone libraries.

Orthology and Conservation Analysis

We investigated conservation of known and predicted precursor and mature human miRNA in chimp (panTro2), monkey (rheMac2), dog (canFam2) mouse (mm8) and rat (rn4). We obtained 678 miRNA precursor sequences from miRBase (v.11.0); 677 (672 unique) mature miRNAs; and 170 (167 unique) star sequences. In total, we obtained 947 locations for mature and star mirBase sequences. We predicted 926 precursors of which 146 match miRBase precursors and 780 are newly predicted. Categorizing these by their corresponding mature sequences, 762 precursors correspond to mature miRNAs that are not included in the miRBase and 164 precursors are associated with 129 predicted miRNAs that match miRBase miRNAs. Of the 762 newly predicted precursors, one overlaps with a miRBase precursor and its corresponding predicted miRNA is a candidate star sequence; 19 precursors associated with 8 mature sequences listed in miRBase database.

Here, we predicted 762 miRNA genomic locations associated with unique mature miRNA sequences not included in miRBase. Of these 762 predicted miRNA genomic locations, one overlaps with a miRBase precursor and is a candidate star sequence. We identified 164 precursors associated with 129 predicted miRNAs matching the sequence of known miRNAs; 19 of the 164 precursors, associated with 9 known miRNAs, do not match known precursors. miRNA conservation has been repeatedly used to help identify putative miRNA mappings to genomes. To identify putative ortholog miRNAs we relied on UCSC-provided Blastz pairwise alignments between human and target species[s5]. We used two related but complementary methods: (1) map the mature human miRNA to its ortholog location as specified by pairwise alignment; and (2) map the precursor of the human miRNA to its ortholog location as specified by pairwise alignment, expanding the human region to include at least 80 bases from both sides of the mature region, and identifying regions in the target that match the sequence of the mature human miRNA.

Method 1 is the simplest but fails to account for alignment inaccuracies and local mutations that may shift the position of the mature sequence in the target species. Method 2 accounts for locally imperfect Blastz mapping, but relies on conservation of larger regions that may not be subject to the same selective pressure as the mature miRNA. Alignment-based mapping of the human mature miRNA to its target were required to have either perfect conservation of the entire mature miRNA sequence or conservation of seeds composed of seven bases starting from the second position of the human mature sequence followed by conservation of 3 bases starting from the 12th, 13th, or 14th position as suggested by[s6]. We scanned the entire mapped ortholog region for a match to the human mature sequence or to its seed.

Comparison with Previously Reported MiRNA Prediction from Short-RNA Libraries

Landgraf et al.[s7] used more restrictive miRNA characterizations for mature miRNA prediction, annotation and conservation. They required that at least 60% of the observations associated with a predicted miRNA align at the 5' end. We made no such restriction, and some of the miRNAs with the highest number of observations in our libraries, such as CU-1026 and CU-1018, are supported by a high proportion of 5'-misaligned cloned sequences. Landgraf et al. eliminated predictions that can be derived from repeat sequences by excluding precursors that contain more than 30% repetitive elements and that match hg18 more than 10 times with at least 75% identity. We annotated mature sequences that match known repeats but did not eliminate them. Finally, Landgraf et al. formulated extensive criteria for sequence orthology, requiring sequence conservation greater than 75% in multiple alignments across vertebrates and either restricting the 20 5'-most misaligned nucleotides to be transitions or requiring 100% conservation in positions 2 through 8 and 90% conservation overall. We, as described above, simply considered full conservation and seed-based conservation, mapping human to primates, dog and rodents.

REFERENCES s1. Griffiths-Jones, S. miRBase: the microRNA sequence database. *Methods Mol Biol* 342, 129-38 (2006).

s2. Griffiths-Jones, S., Grocock, R. J., van Dongen, S., Bateman, A. & Enright, A. J. miRBase: microRNA sequences, targets and gene nomenclature. *Nucleic Acids Res* 34, D140-4 (2006).

s3. Harrell, F. E. *Regression modeling strategies: with applications to linear models, logistic regression, and survival analysis* (Springer, N.Y., 2001).

s4. Hinkley, A. C. D. a. D. V. *Bootstrap Methods and their Applications* (Cambridge University Press, New York, 1997).

s5. Schwartz, S. et al. Human-mouse alignments with BLASTZ. *Genome Res* 13, 103-7 (2003).

s6. Grimson, A. et al. MicroRNA targeting specificity in mammals: determinants beyond seed pairing. *Mol Cell* 27, 91-105 (2007).

s7. Landgraf, P. et al. A mammalian microRNA expression atlas based on small RNA library sequencing. *Cell* 129, 1401-14 (2007).

Example 4 miRNome of Human Mature B Cells

Summary:

The full set of microRNAs (miRNAs) in the human genome is not known. Because presently known miRNAs have been identified by virtue of their abundant expression in a few cell types, many tissue-specific miRNAs remain unrevealed. To understand the role of miRNAs in B cell function and lymphomagenesis, we generated short-RNA libraries from normal human B cells at different stages of development (naïve, germinal center, memory) and from a Burkitt lymphoma cell line. A combination of cloning and computational analysis identified 178 miRNAs (miRNome) expressed in normal and/or transformed B cell libraries. Most notably, the B cell miRNome included 75 miRNAs which to our knowledge have not been previously reported and of which 66 have been validated by RNA blot and/or RT-PCR analyses. Numerous miRNAs were expressed in a stage- or transformation-specific fashion in B cells, suggesting specific functional or pathologic roles. These results provide a resource for studying the role of miRNAs in B cell development, immune function, and lymphomagenesis.

A new mechanism of post-transcriptional regulation has been revealed with the discovery of microRNAs (miRNAs), a class of short RNAs that impair translation or induce mRNA degradation by binding to the 3' untranslated region of target mRNA ([Bartel, 2004] and [Kim, 2005]). A recent release of the miRBase database (v.11.0) ([Griffiths-Jones, 2006] and [Griffiths-Jones et al., 2006]) reports 847 human miRNAs. However, the discovery of miRNAs is still an on-going process with variable predictions about the total number of miRNAs expressed in mammalian cells ranging from one thousand to several thousands ([Bentwich et al., 2005] and [Miranda et al., 2006]). The reported miRNAs have been identified from a limited number of cell types or from tissues whose cellular heterogeneity may favor the identification of ubiquitous and abundant miRNA. In fact, a recent report aiming for the identification of miRNA expression profiles from a large panel of different mammalian tissues and cell types led to the discovery of only 12 previously unreported human miRNA (Landgraf et al., 2007). These findings led to the conclusion that most miRNAs are known and that most of them are ubiquitously expressed (Landgraf et al., 2007). Nonetheless, additional analyses of purified cell populations have led to the identification of tissue- and stage of differentiation-specific miRNAs in a few tissues, suggesting the existence of tissue-specific miRNA expression ([Calabrese et al., 2007] and [Cummins et al., 2006]).

The role of miRNAs in B lymphocyte development and B cell lymphomagenesis is largely unknown. A critical stage of the differentiation process leading to effector B cells is represented by the germinal centers (GC), the structures that develop when mature naive B cells encounter the antigen in the secondary lymphoid organs and are stimulated to proliferate and differentiate into GC centroblasts (CB). During the GC reaction, B cells undergo somatic hypermutation of their immunoglobulin-variable regions and class switch recombination. B cells that have acquired the ability to express high-affinity immunoglobulins are then positively selected and further differentiate into the final effectors of the humoral immune response, i.e., memory B cells and plasma cells (Klein and Dalla-Favera, 2008). Naive, GC, and memory B cells are also relevant targets of disease because each of these B cell subpopulations can be affected by malignant transformation leading to different types of lymphomas and leukemias ([Klein and Dalla-Favera, 2008] and [Kuppers and Dalla-Favera, 2001]).

Several initial observations suggest an important role of specific miRNAs in B cell function and malignancy. Via mouse models, miR-155 has been demonstrated to affect regulation of the GC response through modulation of cytokine production ([Rodriguez et al., 2007] and [That et al., 2007]) and by direct post-transcriptional regulation of the activation-induced cytidine deaminase (AID) ([Dorsett et al., 2008] and [Teng et al., 2008]). Recently, miR-150 has been shown to target MYB, a critical transcription factor involved in the control of B cell differentiation (Xiao et al., 2007). In B cell lymphomas, 13q31 amplification has been associated with the overexpression of the miR-17-92 cluster and its enforced expression in a murine B cell lymphoma model showed a role in accelerating tumor development (He et al., 2005). Furthermore, miR-15a and miR-16 have been implicated in the pathogenesis of B cell chronic lymphocytic leukemia (CLL) ([Calin et al., 2002] and [Calin et al., 2005]).

As a basis for a comprehensive analysis of the role of miRNAs in B cell function and lymphomagenesis, this study was aimed at identifying the miRNAs expressed (miRNome) in the human mature B cell compartment, including naive, GC, and memory B cells. By using a combination of cloning and computational analysis, we report the identification of 178 miRNAs representing the mature B cell miRNome, including 75 previously unreported miRNAs. The results show that normal B cell subpopulations are characterized by specific miRNA "signatures," suggesting functional roles of miRNAs in B cell differentiation and transformation.

Results

Construction of Short-RNA Libraries from Human B Cell Subpopulations.

Figure 23:
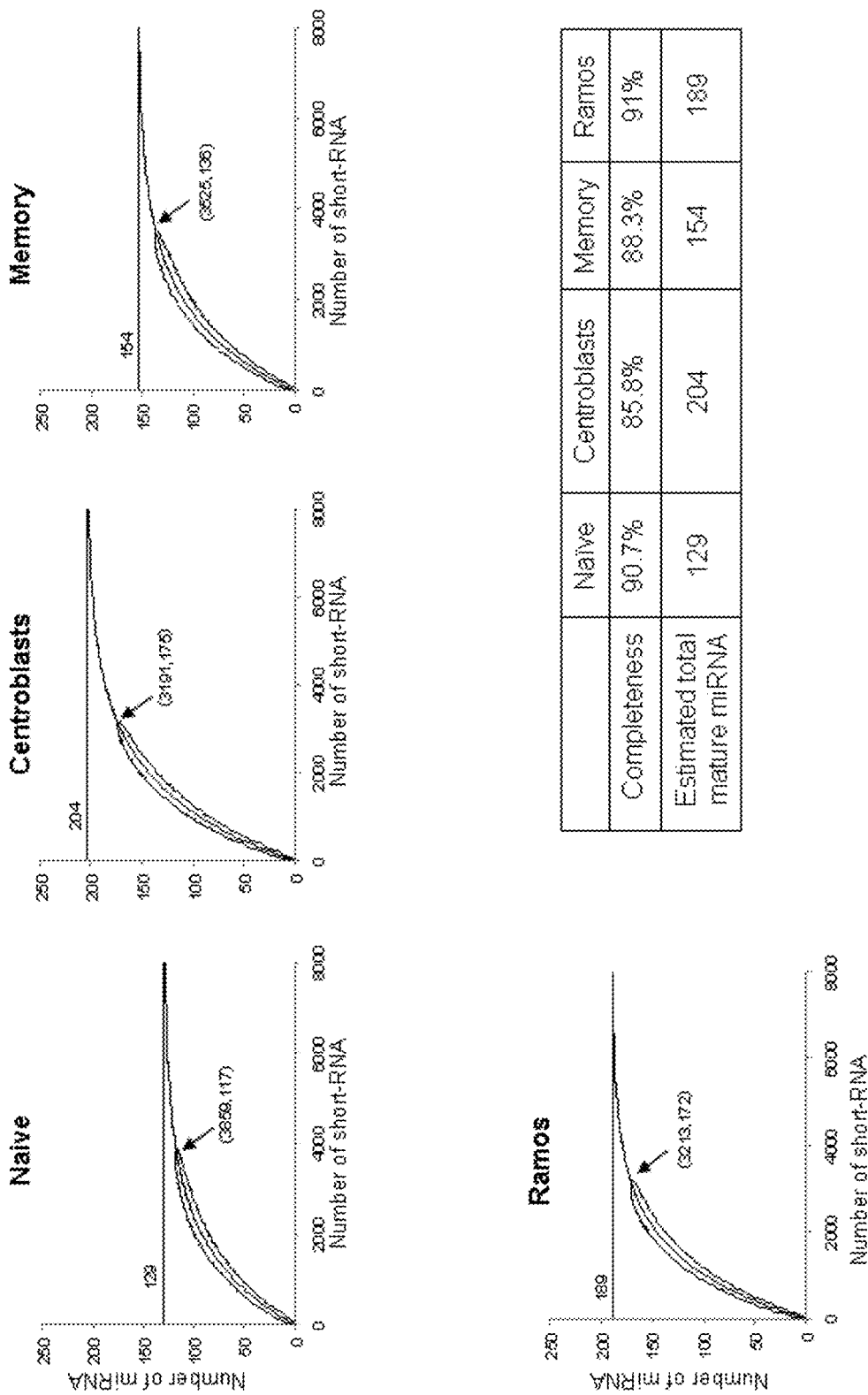
FIG. 23 are graphs that show the complexity of the libraries. The curves represent the estimation of the numbers of mature miRNA (including single occurrence candidate miRNA) expressed in each library. Discarding outliers (extreme 5%), the lowest and highest miRNA counts observed per library sample are plotted. The current set of predicted mature miRNAs represents more than 85% of the estimated miRNA set expressed in the libraries.

Short-RNA libraries were generated by cloning RNA fractions of 15-30 nt from human centroblasts, naive, and memory B cells purified from tonsils, as well as from the Burkitt lymphoma cell line Ramos, which is representative of malignant transformation of GC B cells. Approximately 3,500 sequences were analyzed from each library, corresponding to 13,788 total short-RNAs (2,632 nonredundant sequences). By using a bootstrap approach ([Harrell, 2001] and [Davison and Hinkley, 1997]), we estimated that more than 85% of the complexity of the libraries has been examined (FIG. 23).

Mapping of Short-RNA Sequences to the Human Genome.

Figure 24:
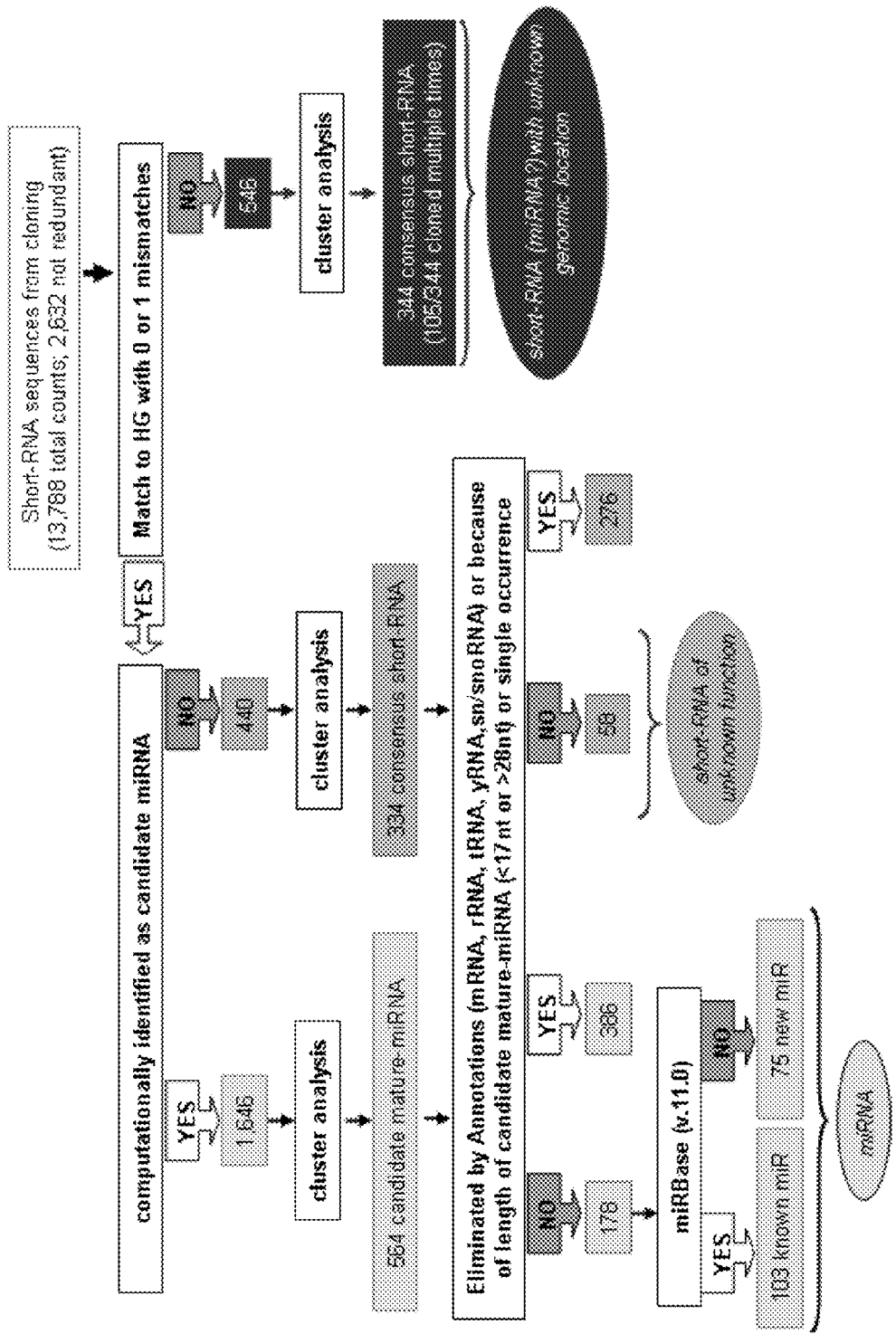
FIG. 24 is a schematic that shows the computational analysis of short-RNA libraries. Short-RNA sequences were grouped in three main categories: miRNAs, short-RNAs of unknown function and short-RNAs not matching the human genome.

The cloned sequences were subjected to a computational analysis (see Supplemental Experimental Procedures described in Example 3) summarized in the flowchart illustrated in FIG. 24. Each cloned sequence was first matched to the human genome assembly (March 2006, hg18) to retrieve the genomic regions from which the short RNAs originated. One or more genomic locations were identified for 2086 (80%) of the cloned sequences considering both perfect matches and single mismatches (FIG. 24). Consistent with previous observations, 3'-end mismatches were the most common and showed a clear preference for A in the last position (Neilson et al., 2007). The failure of 546 short-RNA sequences to align with the human genome is likely due, at least in part, to errors introduced by PCR during the cloning procedure (FIG. 24). However, a small subset of these short RNAs lacking a corresponding genomic region in *Homo sapiens* have been cloned with high frequencies in multiple libraries and showed differential expression during B cell differentiation, suggesting that they may represent bona fide short-RNA species, which cannot be mapped on the current reference genome probably because of polymorphisms and/or post-transcriptional modifications. However, given the difficulty of assigning genomic coordinates to these sequences, they were omitted from further analyses.

Computational Prediction of Precursor and Mature miRNAs.

In order to identify candidate miRNAs among the cloned short-RNA sequences, we developed a computational pipeline aiming at the identification of potential miRNA precursors based on the investigation of their genomic location and folding characteristics (FIG. 18 and Supplemental Experimental Procedures in Example 3). In brief, short RNA sequences were mapped to the human genome and their respective candidate genomic precursors (±90 nt) were retrieved and analyzed for secondary structure, size and energy of the loop, and number of complimentary base pairs in the stem of the loop. The prediction was performed on the full set of nonredundant short RNAs (2632 sequences) for which one or more genomic locations could be identified (FIG. 24). The analysis led to the identification of candidate miRNA precursors for 1646 short-RNA sequences, which were then clustered allowing for (1) the variability observed at the mature miRNA 3' ends (and less dramatically at the 5' ends) including nucleotide substitutions and deletions, and (2) the possibility of miRNA editing as previously reported ([Kawahara et al., 2007] and [Luciano et al., 2004]) (Supplemental Experimental Procedures in Example 3). After annotating each candidate mature miRNA, those which matched mRNA, rRNA, tRNA, post-transcriptionally modified t-RNA, and other ncRNA (yRNA, sn/snoRNA) sequences, and were present only once in the libraries were not considered further. The remaining sequences were still considered miRNAs based on criteria (identification of genomic loci consistent with a pre-miRNA, length, recurrence, differential expression, detection in the Ago complex) that suggest their existence as bona fide miRNA. Moreover, consistent with the miRNA length of the Homo sapiens miRBase database (v11.0), only mature candidate miRNAs of length 17-28 nt were considered.

Figure 19:
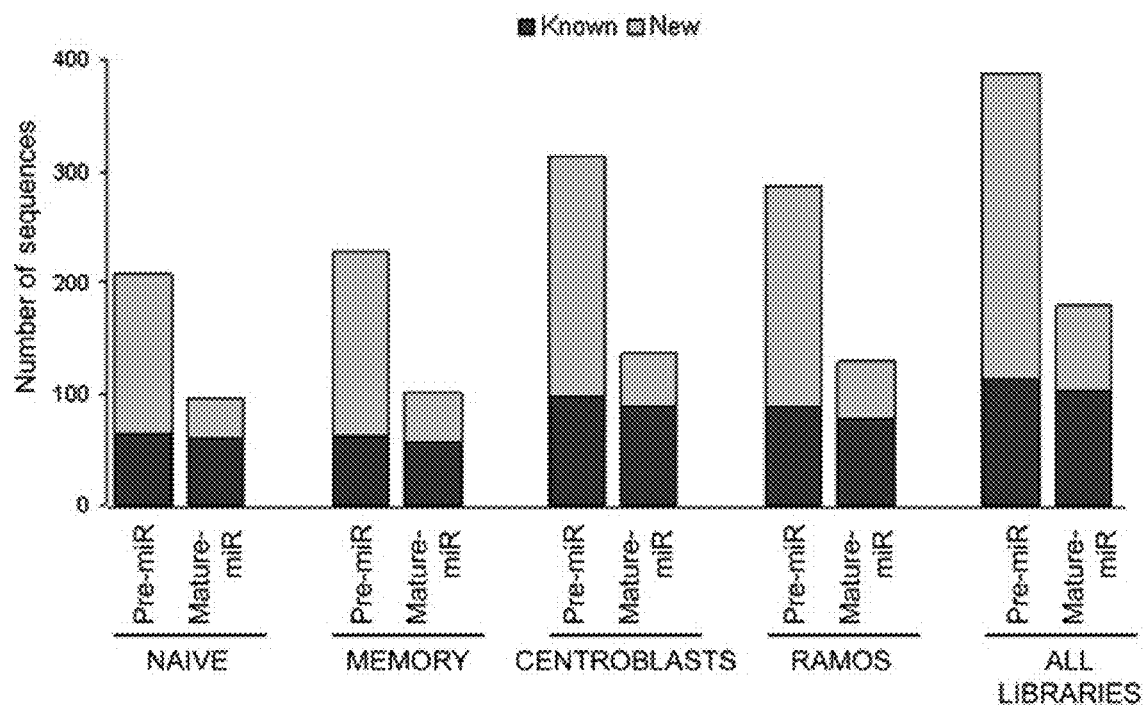
FIG. 19 is a graph of the predicted precursor and mature miRNAs. The number of predicted precursor miRNAs (pre-miR) and mature miRNAs (mature-miR) are plotted independently for each library and overall. Throughout the figures, the sequences matching miRNAs deposited in the miRBase database (v.11.0) are defined as "known," and the sequences that to our knowledge have not been previously reported are named "new.

Overall, the analysis identified 178 mature miRNAs, of which 103 were known and 75 were not previously reported, to our knowledge (Table 7 and FIG. 24). Computational prediction of precursor miRNAs (pre-miRNA) identified 114 precursors already reported to potentially code for the 103 known mature miRNA, and 274 genomic locations containing new candidate pre-miRNA associated with the 75 previously unreported and 8 known mature miRNAs (FIG. 19 and Table 7).

TABLE 7

(PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1026 | 1 | TGTAGTGTTTCCTACTTTATGGA | Mature:hsa-miR-142-3p:MIMAT0000434 |
| CU-1064 | 2 | TAGCTTATCAGACTGATGTTGA | Mature:hsa-miR-21:MIMAT0000076 |
| CU-1061 | 3 | TAAAGTGCTTATAGTGCAGGTAG | Mature:hsa-miR-20a:MIMAT0000075 |
| CU-1035 | 4 | TAGCAGCACATCATGGTTTACA | Mature:hsa-miR-15b:MIMAT0000417 |
| CU-1037 | 5 | TAGCAGCACGTAAATATTGGCG | Mature:hsa-miR-16:MIMAT0000069 |
| CU-1001 | 6 | TGAGGTAGTAGGTTGTATAGTT | Mature:hsa-let-7a:MIMAT0000062 |
| CU-1116 | 7 | TATTGCACTTGTCCCGGCCTGT | Mature:hsa-miR-92a:MIMAT0000092 |
| CU-1018 | 8 | TCCCACCGCTGCCACCA | Mature:hsa-miR-1280:MIMAT0005946 |
| CU-1006 | 9 | TGAGGTAGTAGATTGTATAGTT | Mature:hsa-let-7f:MIMAT0000067 |
| CU-1079 | 10 | TAGCACCATCTGAAATCGGTTA | Mature :hsa-miR-29a:MIMAT0000086 |
| CU-1033 | 11 | TAGCAGCACATAATGGTTTGT | Mature:hsa-miR-15a:MIMAT0000068 |
| CU-1124 | 12 | CCCATAAAGTAGAAAGCACTA | Mature:hsa-miR-142-5p:MIMAT0000433 |
| CU-1007 | 13 | TGAGGTAGTAGTTTGTACAGTT | Mature:hsa-let-7g:MIMAT0000414 |
| CU-1008 | 14 | TGAGGTAGTAGTTTGTGCTGTT | Mature:hsa-let-7i:MIMAT0000415 |
| CU-1082 | 15 | TAGCACCATTTGAAATCGGTTA | Mature:hsa-miR-29c:MIMAT0000681 |
| CU-1085 | 16 | TGTAAACATCCTACACTCTCAGC | Mature:hsa-miR-30c:MIMAT0000244 |
| CU-1039 | 17 | CAAAGTGCTTACAGTGCAGGTAG | Mature:hsa-miR-17:MIMAT0000070 |
| CU-1071 | 18 | CATTGCACTTGTCTCGGTCTGA | Mature:hsa-miR-25:MIMAT0000081 |
| CU-1046 | 19 | CAACGGAATCCCAAAAGCAGCTG | Mature:hsa-miR-191:MIMAT0000440 |
| CU-1057 | 20 | TGTGCAAATCCATGCAAAACTGA | Mature:hsa-miR-19b:MIMAT0000074 |
| CU-1024 | 21 | TACCACAGGGTAGAACCACGGA | Mature:hsa-miR-140-3p:MIMAT0004597 |
| CU-1084 | 22 | TGTAAACATCCTACACTCAGCT | Mature:hsa-miR-30b:MIMAT0000420 |
| CU-1003 | 23 | TGAGGTAGTAGGTTGTGTGGTT | Mature:hsa-let-7b:MIMAT0000063 |
| CU-1080 | 24 | TAGCACCATTTGAAATCAGTGTT | Mature:hsa-miR-29b:MIMAT0000100 |
| CU-1012 | 25 | TAAAGTGCTGACAGTGCAGAT | Mature:hsa-miR-106b:MIMAT0000680 |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1092 | 26 | TCCCTGTCCTCCAGGAGCTC | Mature:hsa-miR-339-5p:MIMAT0000764 |
| CU-1072 | 27 | TTCAAGTAATCCAGGATAGGCT | Mature:hsa-miR-26a:MIMAT0000082 |
| CU-1118 | 28 | CAAAGTGCTGTTCGTGCAGGTAG | Mature:hsa-miR-93:MIMAT0000093 |
| CU-1067 | 29 | TGTCAGTTTGTCAAATACCCCA | Mature:hsa-miR-223:MIMAT0000280 |
| CU-1027 | 30 | TGAGAACTGAATTCCATGGGTT | Mature:hsa-miR-146a:MIMAT0000449 |
| CU-1029 | 31 | TCTCCCAACCCTTGTACCAGT | Mature:hsa-miR-150:MIMAT0000451 |
| CU-1015 | 32 | TCCCTGAGACCCTAACTTGTGA | Mature:hsa-miR-125b:MIMAT0000423 |
| CU-1093 | 33 | TCTCACACAGAAATCGCACCCGTC | Mature:hsa-miR-342-3p:MIMAT0000753 |
| CU-1016 | 34 | GTCCCTGTTCGGGCGCCA | Mature:hsa-miR-1274b:MIMAT0005938 |
| CU-1056 | 35 | TGTGCAAATCTATGCAAAACTGA | Mature:hsa-miR-19a:MIMAT0000073 |
| CU-1086 | 36 | TGTAAACATCCCCGACTGGAAG | Mature:hsa-miR-30d:MIMAT0000245 |
| CU-1065 | 37 | AGCTACATTGTCTGCTGGGTT | Mature:hsa-miR-221:MIMAT0000278 |
| CU-1004 | 38 | AGAGGTAGTAGGTTGCATAGTT | Mature:hsa-let-7d:MIMAT0000065 |
| CU-1011 | 39 | CCGCACTGTGGGTACTTGCT | Star:hsa-miR-106b*:MIMAT0004672 |
| CU-1010 | 40 | AGCAGCATTGTACAGGGCTATGA | Mature:hsa-miR-103:MIMAT0000101 |
| CU-1050 | 41 | AACTGGCCCTCAAAGTCCCGCT | Mature:hsa-miR-193b:MIMAT0002819 |
| CU-1091 | 42 | GCCCCTGGGCCTATCCTAGAA | Mature:hsa-miR-331-3p:MIMAT0000760 |
| CU-1023 | 43 | AGCTGGTGTTGTGAATCAGGCCGT | Mature:hsa-miR-138:MIMAT0000430 |
| CU-1101 | 44 | TGAGGGGCAGAGAGCGAGACTT | Mature:hsa-miR-423-5p:MIMAT0004748 |
| CU-1066 | 45 | GCTACATCTGGCTACTGGGTCT | Mature:hsa-miR-222:MIMAT0000279 |
| CU-1017 | 46 | GTGGGGAGAGGCTGTA | Mature:hsa-miR-1275:MIMAT0005929 |
| CU-5001 | 47 | CTATACGACCTGCTGCCTTTC | Star:hsa-let-7d*:MIMAT0004484 |
| CU-1032 | 48 | TTAATGCTAATCGTGATAGGGGT | Mature:hsa-miR-155:MIMAT0000646 |
| CU-1108 | 49 | AGGGGGAAAGTTCTATAGTC | Mature:hsa-miR-625:MIMAT0003294 |
| CU-1055 | 50 | ACAGTAGTCTGCACATTGGTT | Mature:hsa-miR-199b-3p:MIMAT0004563 |
| CU-1042 | 51 | AACATTCAACGCTGTCGGTGAGTT | Mature:hsa-miR-181a:MIMAT0000256 |
| CU-1113 | 52 | TGGAAGACTAGTGATTTTGTTGT | Mature:hsa-miR-7:MIMAT0000252 |
| CU-1098 | 53 | TAATGCCCCTAAAAATCCTTAT | Mature:hsa-miR-365:MIMAT0000710 |
| CU-1052 | 54 | TAGCAGCACAGAAATATTGGCA | Mature:hsa-miR-195:MIMAT0000461 |
| CU-1568 | 55 | TGAGGTAGTAGGTTGTAT | Mature:hsa-let-7c:MIMAT0000064 |
| CU-1103 | 56 | TCCTGTACTGAGCTGCCCCGAG | Mature:hsa-miR-486-5p:MIMAT0002177 |
| CU-1014 | 57 | TCCCTGAGACCCTTTAACCTGTGA | Mature:hsa-miR-125a-5p:MIMAT0000443 |
| CU-1068 | 58 | ATCACATTGCCAGGGATTTCCA | Mature:hsa-miR-23a:MIMAT0000078 |
| CU-1019 | 59 | TCACAGTGAACCGGTCTCTTT | Mature:hsa-miR-128:MIMAT0000424 |
| CU-1076 | 60 | CACTAGATTGTGAGCTCCTGGA | Mature:hsa-miR-28-3p:MIMAT0004502 |
| CU-1111 | 61 | CAACAAATCACAGTCTGCCAT | Star:hsa-miR-7-1*:MIMAT0004553 |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1062 | 62 | CAAAGTGCTTATAGTGCAGGTAG | Mature:hsa-miR-20b-mm:MIMAT0001413 |
| CU-1115 | 63 | AGGTTGGGATCGGTTGCAATGCT | Star:hsa-miR-92a-1*:MIMAT0004507 |
| CU-1126 | 64 | ACATTCATTGCTGTCGGTGGGTT | Mature:hsa-miR-181b:MI0000270 |
| CU-5016 | 1093 | AATGACACGATCACTCCCGTTGAG | Mature :hsa-miR-425:MIMAT0003393 |
| CU-1096 | 65 | TCCCCCAGGTGTGATTCTGATT | Mature:hsa-miR-361-3p:MIMAT0004682 |
| CU-1054 | 66 | CCCAGTGTTCAGACTACCTGTTC | Mature:hsa-miR-199a-5p:MIMAT0000231 |
| CU-1112 | 67 | ACCAATATTACTGTGCTGCTT | Star:hsa-miR-16-2*:MIMAT0004518 |
| CU-1087 | 68 | TGTAAACATCCTTGACTGGAAGCT | Mature:hsa-miR-30e:MIMAT0000692 |
| CU-1045 | 69 | TAAGGTGCATCTAGTGCAGATA | Mature:hsa-miR-18a:MIMAT0000072 |
| CU-1069 | 70 | ATCACATTGCCAGGGATTACCA | Mature:hsa-miR-23b:MIMAT0000418 |
| CU-1044 | 71 | ACTGCCCTAAGTGCTCCTTCTG | Star:hsa-miR-18a*:MIMAT0002891 |
| CU-1083 | 72 | TGTAAACATCCTCGACTGGA | Mature:hsa-miR-30a:MIMAT0000087 |
| CU-1009 | 73 | TACAGTACTGTGATAACTGAAG | Mature:hsa-miR-101:MIMAT0000099 |
| CU-1030 | 74 | CTAGACTGAAGCTCCTTGAGG | Mature:hsa-miR-151-3p:MIMAT0000757 |
| CU-1088 | 1094 | TGGGTTGAGAGGGCGAA | Mature:hsa-miR-320a:MIMAT0000510 |
| CU-1095 | 75 | TGGCAGTGTCTTAGCTGGTTGTT | Mature:hsa-miR-34a:MIMAT0000255 |
| CU-1119 | 76 | TGAGGTAGTAAGTTGTATTGTT | Mature:hsa-miR-98:MIMAT0000096 |
| CU-1028 | 77 | TGAGAACTGAATTCCATAGGCTGT | Mature:hsa-miR-146b-5p:MIMAT0002809 |
| CU-1031 | 78 | TCGAGGAGCTCACAGTCTAGTA | Mature:hsa-miR-151-5p:MIMAT0004697 |
| CU-1100 | 79 | AGCTCGGTCTGAGGCCCCTCAG | Mature:hsa-miR-423-3p:MIMAT0001340 |
| CU-1038 | 80 | ACTGCAGTGAAGGCACTTGTAG | Star:hsa-miR-17*:MIMAT0000071 |
| CU-1040 | 81 | ACCATCGACCGTTGATTGTA | Star:hsa-miR-181a*:MIMAT0000270 |
| CU-1053 | 82 | TTCACCACCTTCTCCACCCAG | Mature:hsa-miR-197:MIMAT0000227 |
| CU-1075 | 83 | TTCACAGTGGCTAAGTTCTG | Mature:hsa-miR-27b:MIMAT0000419 |
| CU-1073 | 84 | TTCAAGTAATTCAGGATAGGTT | Mature:hsa-miR-26b:MIMAT0000083 |
| CU-1110 | 85 | TGGGTTTACGTTGGGAGAACT | Mature:hsa-miR-629:MIMAT0004810 |
| CU-1005 | 87 | TGAGGTAGGAGGTTGTATAGTT | Mature:hsa-let-7e:MIMAT0000066 |
| CU-1081 | 88 | TGACCGATTTCTCCTGGTGTT | Star:hsa-miR-29c*:MIMAT0004673 |
| CU-1117 | 89 | TATTGCACTCGTCCCGGCC | Mature:hsa-miR-92b:MIMAT0003218 |
| CU-1094 | 90 | GGGGTGCTATCTGTGATTGA | Mature:hsa-miR-342-5p:MIMAT0004694 |
| CU-1021 | 91 | GCATGGGTGGTTCAGTGGTAGAA | Mature:hsa-miR-1308:MIMAT0005947 |
| CU-1089 | 92 | CTGGCCCTCTCTGCCCTT | Mature:hsa-miR-328:MIMAT0000752 |
| CU-1047 | 93 | CTGACCTATGAATTGACAGC | Mature:hsa-miR-192:MIMAT0000222 |
| CU-1099 | 94 | CTCCTGACTCCAGGTCCTGTG | Star:hsa-miR-378*:MIMAT0000731 |
| CU-1105 | 95 | CGTCAACACTTGCTGGTT | Mature:hsa-miR-505:MIMAT0002876 |
| CU-1034 | 96 | CGAATCATTATTTGCTGCTCT | Star:hsa-miR-15b*:MIMAT0004586 |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-5002 | 97 | CATCGGGAATGTCGTGTCCGCC | Star:hsa-miR-425*:MI0001448 |
| CU-1025 | 98 | CAGTGGTTTTACCCTATGGTA | Mature:hsa-miR-140-5p:MIMAT0000431 |
| CU-1022 | 99 | CAGTGCAATGATGAAAGGGCAT | Mature:hsa-miR-130b:MIMAT0000691 |
| CU-1104 | 100 | CAGCAGCACACTGTGGTTTGT | Mature:hsa-miR-497:MIMAT0002820 |
| CU-1106 | 101 | CACGCTCATGCACACACCCAC | Mature:hsa-miR-574-3p:MIMAT0003239 |
| CU-1077 | 102 | AAGGAGCTCACAGTCTATTGAG | Mature:hsa-miR-28-5p:MIMAT0000085 |
| CU-1132 | 131 | GCCGGGTACTTTCGTATTTT | NEW |
| CU-1137 | 132 | GCTAAGGAAGTCCTGTGCTCAGTTTT | NEW |
| CU-1178 | 148 | GGGTGTGCGTGTTTTT | NEW |
| CU-1164 | 150 | GAGAGCGCTCGGTTTTT | NEW |
| CU-1148 | 151 | TGGTGTGGTCTGTTGTTTT | NEW |
| CU-1221 | 152 | TGTGCTCCGGAGTTACCTCGTTT | NEW |
| CU-1180 | 155 | AACCGAGCGTCCAAGCTCTTTCCATTTT | NEW |
| CU-1155 | 156 | TCCCCGCACCTCCACCA | NEW |
| CU-1175 | 162 | GGCGTGATTCATACCTTTT | NEW |
| CU-1197 | 169 | TGTGGTGGCTTACTTTT | NEW |
| CU-1146 | 172 | AGAAAGGCCGAATTTTA | NEW |
| CU-1212 | 157 | TCCCCGGCACTTCCACCA | NEW |
| CU-1251 | 232 | CCCACCCAGGGACGCCA | tRNAprefix-annotate;refseqGeneIntron-annotate; |
| CU-1254 | 233 | TCCCCGGCACCTCCACCA | tRNAprefix-annotate;refseqGeneIntron-annotate; |
| CU-1298 | 234 | ATCCCGGACGAGCCCCCA | tRNAprefix-annotate;refseqGeneIntron-annotate; |
| CU-1153 | 142 | CCCCCCACTGCTAAATTTGACTGGCTT | refseqGeneIntron-annotate;rnaGene-annotate |
| CU-1276 | 236 | TCGATTCCCGGCCAATGCACCA | tRNAprefix-annotate;refseqGeneIntron-annotate; |
| CU-1303 | 237 | ATCCCACTTCTGACACCA | computGene-annotate;refseqGeneIntron-annotate; tRNAprefix-annotate |
| CU-1242 | 239 | TCCCCGTACGGGCCACCA | tRNAprefix-annotate;refseqGeneIntron-annotate; |
| CU-1241 | 243 | AGTCCCATCTGGGTCGCCA | tRNAprefix-annotate;refseqGeneIntron-annotate; |
| CU-1575 | 244 | CCCCCCACTGCTAAATTTGACTGGA | refseqGeneIntron-annotate;rnaGene-annotate |
| CU-1243 | 246 | GTCCCTTCGTGGTCGCCA | tRNAprefix-annotate;refseqGeneIntron-annotate; |
| CU-1300 | 248 | TCCTCACACGGGGCACCA | tRNAprefix-annotate;refseqGeneIntron-annotate; |
| CU-1278 | 249 | TAACGGCCGCGGTACCC | refseqGeneIntron-annotate |
| CU-1264 | 250 | GAGGGGGACCAAAAAAAA | refseqGeneIntron-annotate |
| CU-1130 | 133 | CCCGGGTTTCGGCACCA | tRNAprefix-annotate;refseqGeneIntron-annotate; |
| CU-1380 | 354 | TAGGTTTGGTCCTAGCCTTTCT | piRNA-annotate;refseqGeneIntron-annotate |
| CU-1246 | 252 | GGGGGGTAAAAAAAAA | refseqGeneIntron-annotate |
| CU-1277 | 254 | GAGCCATGATGATACCACTGAGC | refseqGeneIntron-annotate |
| CU-1345 | 257 | AGAACACTACGAGCCACA | mRNA-annotate;refseqGeneIntron-annotate |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1352 | 258 | ACCCCACTTCTGGTACCA | tRNAprefix-annotate;refseqGeneIntron-annotate; |
| CU-1324 | 260 | TCTCGGTGGAACCTCCA | tRNAprefix-annotate;refseqGeneIntron-annotate; |
| CU-1269 | 262 | TACCGAGCCTGGTGATAGC | refseqGeneIntron-annotate |
| CU-1281 | 263 | GCAGCGCCAGCCTCCCGCCCTAC | refseqGeneIntron-annotate |
| CU-1339 | 265 | ATCCCCAGCACCTCCACCA | tRNAprefix-annotate;refseqGeneIntron-annotate; |
| CU-1293 | 266 | AGCAGTGATGTCCTGAAAATTCTGAAG | refseqGeneIntron-annotate |
| CU-1307 | 267 | ACCCCACTATGCTTAGCCCT | mRNA-annotate;refseqGeneIntron-annotate |
| CU-1294 | 268 | AAAGGACCTGGCGGTGCTTC | mRNA-annotate;refseqGeneIntron-annotate |
| CU-1369 | 350 | TCCCCGGCATCTCCACCA | coMputGene-annotate;tRNAprefix-annotate |
| CU-1191 | 143 | GCCCGCATCCTCCACCA | tRNAprefix-annotate; |
| CU-1173 | 145 | ATCCCACTCCTGACACCA | tRNAprefix-annotate; |
| CU-1142 | 149 | TCGATTCCCGGCCCATGCACCA | tRNAprefix-annotate; |
| CU-1186 | 153 | TCCCCGACACCTCCACCA | tRNAprefix-annotate; |
| CU-1371 | 352 | TCTAGAGGAGCCTGTTCTGTA | mRNA-annotate |
| CU-1381 | 353 | TCGATTCCCGGTCAGGGAACCA | repeats-annotate;tRNAprefix-annotate |
| CU-1213 | 158 | TCACCCCATAAACACCA | tRNAprefix-annotate; |
| CU-1363 | 355 | CGTTCGCGCTTTCCCCTG | rnaGene-annotate |
| CU-1220 | 161 | TTCCCCGACGGGGAGCCA | tRNAprefix-annotate; |
| CU-1396 | 356 | TAAGTGTTTGTGGGTTA | rnaGene-annotate |
| CU-1570 | 171 | ATCCCCAGCATCTCCACCA | tRNAprefix-annotate; |
| CU-1524 | 368 | CCCCCACAACCGCGCTTGACTAGC | mRNAall-annotate;yRNA-eliminate;rnaGene-annotate |
| CU-1453 | 369 | CCCTGCTCGCTGCGCCA | tRNAprefix-annotate;refseqGeneExon-eliminate; |
| CU-1477 | 370 | CTCCCACTGCTTCACTTGACTAGC | yRNA-eliminate;refseqGeneIntron-annotate;rnaGene-annotate |
| CU-1222 | 372 | TCACGTCGGGGTCACCA | refseqGeneExon-eliminate;tRNAprefix-annotate |
| CU-1388 | 373 | TCCCTGGTGGTCTAGTGGTTAGGATTCG | tRNAcomputational-annotate;refseqGeneIntron-annotate;rnaGene-annotate;HStRNA-eliminate;piRNA-annotate |
| CU-1488 | 375 | TCCTGCCGCGGTCGCCA | tRNAprefix-annotate;refseqGeneExon-eliminate; |
| CU-1557 | 376 | GGAGAGAACGCGGTCTGAGTGGT | snoRNA-eliminate;wgRNA-annotate;rnaGene-annotate |
| CU-1379 | 377 | TCGGGTGCGAGAGGTCCCGGGT | tRNAcomputational-annotate;HStRNA-eliminate;rnaGene-annotate |
| CU-1542 | 378 | GGCTGGTCCGATGGTAGTGGGTT | mRNAall-annotate;yRNA-eliminate;refseqGeneIntron-annotate;rnaGene-annotate |
| CU-1550 | 379 | CGGAAGCGTGCTGGGCCC | tRNAcomputational-annotate;tRNA-eliminate;rnaGene-annotate;HStRNA-eliminate;piRNA-annotate |
| CU-1513 | 381 | GCGGGTGATGCGAACTGGAGTCTGAGC | computGene-annotate;snoRNA-annotate;refseqGeneExon-eliminate;rnaGene-annotate;snoRNA-eliminate;wgRNA-annotate |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1368 | 382 | GACGAGGTGGCCGAGTGG | tRNAcomputational-annotate;rnaGene-annotate; HStRNA-eliminate;piRNA-annotate |
| CU-1370 | 351 | CTGATTGCTCCTGTCTGATT | mRNAall-annotate;refseqGeneExon-eliminate;wgRNA-annotate;exEID-annotate;rnaGene-annotate |
| CU-1470 | 384 | CTCCTGGCTGGCTCGCCA | mRNAall-annotate;computGene-annotate;exEID-annotate;tRNAprefix-annotate;refseqGeneIntron-annotate;refseqGeneExon-eliminate; |
| CU-1538 | 386 | GGCTGGTCCGAGTGCAGTGGTGTTTA | yRNA-eliminate;refseqGeneIntron-annotate; rnaGene-annotate |
| CU-1486 | 387 | CTGCTGTGATGACATTC | computGene-annotate;snoRNA-annotate; refseqGeneExon-eliminate;rnaGene-annotate; snoRNA-eliminate;wgRNA-annotate |
| CU-1382 | 389 | TCCTCGTTAGTATAGTGGTGAGTATCCC | tRNAcomputational-annotate;rnaGene-annotate; HStRNA-eliminate;piRNA-annotate |
| CU-1403 | 391 | GCATTGGTGGTTCAGTGGTAGA | rnaGene-annotate;tRNAcomputational-annotate; piRNA-annotate;tRNA-eliminate;refseqGeneIntron-annotate;HStRNA-eliminate |
| CU-1457 | 395 | TTCTCACTACTGCACTTGACTA | mRNAall-annotate;exEID-annotate;yRNA-eliminate; rnaGene-annotate;refseqGeneIntron-annotate; refseqGeneExon-eliminate |
| CU-1440 | 396 | TGGTTATCACGTTCGCC | tRNAcomputational-annotate;tRNA-eliminate; rnaGene-annotate;HStRNA-eliminate;piRNA-annotate |
| CU-1528 | 397 | TAGGGGTATGATTCTCGCT | tRNAcomputational-annotate;tRNA-eliminate; HStRNA-eliminate;rnaGene-annotate |
| CU-1288 | 255 | CGTCCATGATGTTCCGCAA | mRNAall-annotate;snoRNA-annotate; refseqGeneIntron-annotate;refseqGeneExon-eliminate;piRNA-annotate;wgRNA-annotate |
| CU-1545 | 398 | CCACGAGGAAGAGAGGTAGC | snoRNA-annotate;snoRNA-eliminate;wgRNA-annotate; rnaGene-annotate |
| CU-1323 | 259 | TGTATTGTGAGACATTC | mRNAall-annotate;refseqGeneExon-eliminate; refseqGeneIntron-annotate;wgRNA-annotate; rnaGene-annotate |
| CU-1244 | 399 | GTCAGGATGGCCGAGCGGTCT | tRNAcomputational-annotate;rnaGene-annotate; HStRNA-eliminate;refseqGeneIntron-annotate |
| Candidate miRNAs observed only once in any of the four libraries | | | |
| CU-1123 | 103 | TTGGTCCCCTTCAACCAGCTGT | Mature:hsa-miR-133a:MIMAT0000427 |
| CU-1074 | 104 | TTCACAGTGGCTAAGTTCCGA | Mature:hsa-miR-27a:MIMAT0000084 |
| CU-1097 | 105 | TTATCAGAATCTCCAGGGGTAA | Mature:hsa-miR-361-5p:MIMAT0000703 |
| CU-1043 | 106 | TGGAGAGAAAGGCAGTTCCTGAT | Mature:hsa-miR-185:MIMAT0000455 |
| CU-1112 | 107 | TGAGACCTCTGGGTTCTGAGCT | Mature:hsa-miR-769-5p:MIMAT0003886 |
| CU-1122 | 108 | TCTTTGGTTATCTAGCTGTATGA | Mature:hsa-miR-9:MIMAT0000441 |
| CU-1109 | 109 | TCTAGTAAGAGTGGCAGTCGA | Mature:hsa-miR-628-3p:MIMAT0003297 |
| CU-1090 | 110 | TATTGCACATTACTAAGTTGA | Mature:hsa-miR-32:MIMAT0000090 |
| CU-1013 | 111 | TAAGGCACGCGGTGAATGCCA | Mature:hsa-miR-124:MIMAT0000422 |
| CU-1058 | 112 | TAACACTGTCTGGTAACGATGTT | Mature:hsa-miR-200a:MIMAT0000682 |
| CU-1059 | 113 | GTGAAATGTTTAGGACCACTAG | Mature:hsa-miR-203:MIMAT0000264 |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1102 | 114 | GCAGTCCATGGGCATATACACA | Mature:hsa-miR-455-3p:MIMAT0004784 |
| CU-1107 | 115 | GAGCTTATTCATAAAAGTGCAG | Mature:hsa-miR-590-5p:MIMAT0003258 |
| CU-1114 | 116 | CTGCCCTGGCCCGAGGGACCGA | Mature:hsa-miR-874:MIMAT0004911 |
| CU-1002 | 117 | CTATACAACCTACTGCCTTC | Star:hsa-let-7b*:MIMAT0004482 |
| CU-1049 | 118 | CGGGGTTTTGAGGGCGAGATGA | Star:hsa-miR-193b*:MIMAT0004767 |
| CU-1051 | 119 | CCAGTGGGGCTGCTGTTATCTG | Star:hsa-miR-194*:MIMAT0004671 |
| CU-1036 | 120 | CCAGTATTAACTGTGCTGCTGA | Star:hsa-miR-16-1*:MIMAT0004489 |
| CU-1121 | 121 | CACCCGTAGAACCGACCTTGCG | Mature:hsa-miR-99b:MIMAT0000689 |
| CU-1120 | 122 | CAAGCTCGTGTCTGTGGGTCCG | Star:hsa-miR-99b*:MIMAT0004678 |
| CU-1063 | 123 | CAACACCAGTCGATGGGCTGTA | Star:hsa-miR-21*:MIMAT0004494 |
| CU-1070 | 124 | AGGCGGAGACTTGGGCAATT | Star:hsa-miR-25*:MIMAT0004498 |
| CU-1060 | 125 | ACTGCATTATGAGCACTTAAAGT | Star:hsa-miR-20a*:MIMAT0004493 |
| CU-1078 | 126 | ACTGATTTCTTTTGGTGTTCA | Star:hsa-miR-29a*:MIMAT0004503 |
| CU-1020 | 127 | ACTCGGCGTGGCGTCGGTCGTGG | Mature:hsa-miR-1307:MIMAT0005951 |
| CU-1041 | 128 | ACCACTGACCGTTGACTGTAC | Star:hsa-miR-181a-2*:MIMAT0004558 |
| CU-1048 | 129 | AACTGGCCTACAAAGTCCCAGT | Mature:hsa-miR-193a-3p:MIMAT0000459 |
| CU-1136 | 134 | TCGGGCGGGAGTGGTGGCTTT | NEW |
| CU-1383 | 135 | TAGAGGCACCGCCTGCCCA | NEW |
| CU-1131 | 136 | CGGGGCGCGGCCTCGCTG | NEW |
| CU-1135 | 137 | CCCACGGGGTCTCCGGGCGAG | NEW |
| CU-1133 | 139 | CAGCCCGGCCTGGCTCCTCCAT | NEW |
| CU-1134 | 140 | CACGGAAGGTGGCCCGG | NEW |
| CU-1160 | 174 | TGTCAGTTTGAACCCAA | NEW |
| CU-1189 | 175 | TGTAGTGTTTCTTACTTTA | NEW |
| CU-1219 | 176 | TGGCGAAGGTCGGCCGCG | NEW |
| CU-1190 | 179 | TCGGCTTTCCCTGCTAACTGGGCTTTTT | NEW |
| CU-1144 | 180 | TCAGAGCGCGGGCCGACCCC | NEW |
| CU-1384 | 183 | TAACCCCAGGGTTGGTCA | NEW |
| CU-1171 | 185 | GGGCGTGGGTGTGATGATTC | NEW |
| CU-1199 | 186 | GGGAGGTGAGTAGGTCTG | NEW |
| CU-1226 | 187 | GGAGACGTGGCCGAGAG | NEW |
| CU-1572 | 188 | GCGGAATACCACGGGGA | NEW |
| CU-1151 | 189 | GCAGGCGGGGATTAGCTA | NEW |
| CU-1227 | 190 | GCAGCGGAACGTCGGCGCGC | NEW |
| CU-1152 | 192 | CTTGGACTAACCTGGTGTA | NEW |
| CU-1207 | 197 | CGGTGGAACCTGCATTGGTTT | NEW |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1181 | 198 | CGGGGCCGGGGCTAGGGT | NEW |
| CU-1185 | 199 | CGGGCCGCCCCGCCCACCG | NEW |
| CU-1366 | 201 | CGGCCTATCCGGAATGCCCC | NEW |
| CU-1145 | 203 | CGCGGCCAGTGTCCCCTTGTA | NEW |
| CU-1201 | 204 | CGACACACGGCCCGTGGCGC | NEW |
| CU-1172 | 206 | CCTCACTGGGGGCTCCA | NEW |
| CU-1217 | 210 | CCGCCCCGACCTTAGCTA NEW | NEW |
| CU-1177 | 214 | CCCCGGCATCTCCATCA | NEW |
| CU-1360 | 218 | CCACCCTGGAGCCTCCGT | NEW |
| CU-1179 | 221 | ATGGCCTGGACCCCACTCCT | NEW |
| CU-1161 | 222 | ATGGCCGCATATATTTT | NEW |
| CU-1168 | 225 | AGCGAGGGTTCCGCCGGCC | NEW |
| CU-1195 | 226 | ACTGGGGAGGGGAGGAGCCTCGAGG | NEW |
| CU-1215 | 227 | ACCCCGAGGGGACGGGCG | NEW |
| CU-1208 | 228 | ACAGCGCTGTGTTCCCGT | NEW |
| CU-1373 | 230 | AACTAAAACCCCTACGCA | NEW |
| CU-1196 | 231 | AAAGGAGCCGAATCTTT | NEW |
| CU-1204 | 224 | ATCCTGCTCACAGCCCCA | NEW |
| CU-1325 | 269 | TTTGCCACACTGCAACACCTT | refseqGeneIntron-annotate |
| CU-1310 | 271 | TTAAACCACCAAGATCGCTGATGCAC | refseqGeneIntron-annotate |
| CU-1299 | 272 | TGTTCGCCGACCGTTGA | refseqGeneIntron-annotate |
| CU-1165 | 173 | TGTCAGTTTTTACCCAA | refseqGeneIntron-annotate |
| CU-1322 | 274 | TGGGAGAGCAGGGTATTGT | refseqGeneIntron-annotate |
| CU-1203 | 177 | TGCAGGGCCGGCGGGGAGG | refseqGeneIntron-annotate |
| CU-1308 | 277 | TCCGAAAGGCCTCCCGCACCG | refseqGeneIntron-annotate |
| CU-1376 | 181 | TCAACACCCACTCCCTC | refseqGeneIntron-annotate |
| CU-1138 | 182 | TATCAATGATGCTTCTGAGA | refseqGeneIntron-annotate |
| CU-1297 | 279 | TAGATGAATAGGTAAAGAG | refseqGeneIntron-annotate |
| CU-1235 | 280 | GTGTATGATGACCTCATGTAGCCTGAAC | refseqGeneIntron-annotate |
| CU-1253 | 281 | GTGAAGCGTTCCATATTTTT | mRNAall-annotate;refseqGeneIntron-annotate; rnaGene-annotate |
| CU-1337 | 283 | GGGGGGAGGGAAGGCAA | refseqGeneIntron-annotate |
| CU-1316 | 284 | GGGGGCTGGGCTGGGTA | refseqGeneIntron-annotate |
| CU-1343 | 285 | GGGGCCGCCGCCTGTGT | refseqGeneIntron-annotate |
| CU-1326 | 286 | GGGAGTCCGCGGCGAGC | refseqGeneIntron-annotate |
| CU-1286 | 288 | GGCTTGGTCTAGGGGTA | refseqGeneIntron-annotate |
| CU-1332 | 289 | GGCTGGGACCCTGGACAC | refseqGeneIntron-annotate |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1262 | 290 | GGCGACCTGCGACTCCTT | refseqGeneIntron-annotate |
| CU-1317 | 292 | GGAGGGGGGAAAAAAAAAA | computGene-annotate;refseqGeneIntron-annotate |
| CU-1266 | 295 | GCCGGGCGTGGTGGTCTG | refseqGeneIntron-annotate |
| CU-1261 | 296 | GCCGCCGAGACCCCAGGACCC | refseqGeneIntron-annotate |
| CU-1259 | 298 | GCAAATGATGCCCTCTGATC | refseqGeneIntron-annotate |
| CU-1349 | 299 | GAGGGGGGTCAAAAAAA | refseqGeneIntron-annotate |
| CU-1272 | 300 | CTTGATGATGAGCAGGATCTGAGT | refseqGeneIntron-annotate |
| CU-1313 | 303 | CTGCTTAAGTCCTGACCAG | refseqGeneIntron-annotate |
| CU-1157 | 196 | CTGATGTTGATGCATATGATGACA | refseqGeneIntron-annotate |
| CU-1296 | 304 | CTGAGCACCTTTCCCTTCC | refseqGeneIntron-annotate |
| CU-1245 | 306 | CGGTCACACGATTAACCCA | mRNA-annotate;refseqGeneIntron-annotate |
| CU-1319 | 310 | CGGGAGTGGGGTGGCGCCCAG | refseqGeneIntron-annotate |
| CU-1569 | 312 | CGGACCTGATAAATTCCCAC | refseqGeneIntron-annotate |
| CU-1351 | 316 | CCTTCCTTGGATGTCTGAGTGAG | mRNAall-annotate;refseqGeneIntron-annotate;wgRNA-annotate;rnaGene-annotate |
| CU-1354 | 317 | CCTCGCTGGGGCCTCCA | tRNAprefix-annotate;refseqGeneIntron-annotate; |
| CU-1228 | 321 | CCGCCCGTCACCCTCCTCAAGTA | mRNA-annotate;refseqGeneIntron-annotate |
| CU-1271 | 323 | CCCGCGGGCTTGCTGGGCGTCCC | refseqGeneIntron-annotate |
| CU-1166 | 213 | CCCCGGCCCATGCACCA | refseqGeneIntron-annotate; |
| CU-1285 | 325 | CCCCGGCATCTCCACTA | refseqGeneIntron-annotate |
| CU-1571 | 326 | CCCCAGTGAGTGCCCTCTTCC | refseqGeneIntron-annotate |
| CU-1353 | 327 | CCCAGAGACGCCGTCCTCGA | refseqGeneIntron-annotate |
| CU-1347 | 330 | CCACTCCAGCCTAGCCCC | refseqGeneIntron-annotate |
| CU-1295 | 331 | CAGTACAGGCACACCTC | refseqGeneIntron-annotate |
| CU-1250 | 333 | CACGATTAACCCAAGTC | mRNA-annotate;refseqGeneIntron-annotate |
| CU-1311 | 337 | ATACCATGATGAACAATAGCTGAGA | refseqGeneIntron-annotate |
| CU-1350 | 339 | AGGCTGTGATGGACCTGGCTGAGCCTG | refseqGeneIntron-annotate |
| CU-1252 | 340 | AGAGAGTAGGGGGAGGT | refseqGeneIntron-annotate |
| CU-1334 | 341 | ACTGTCCCTGTCTACTA | refseqGeneIntron-annotate |
| CU-1340 | 342 | ACCGCATCTGGCCTATTTTT | refseqGeneIntron-annotate |
| CU-1342 | 343 | ACCAGACCTCCTGTGCGAAG | refseqGeneIntron-annotate |
| CU-1304 | 344 | ACAGCCCGGATCCCAGCCCACTTA | refseqGeneIntron-annotate |
| CU-1230 | 345 | ACACTGAGCCACAACCCA | refseqGeneIntron-annotate |
| CU-1192 | 229 | ACAAAAAAAAAAGCCCAACCCT | refseqGeneIntron-annotate |
| CU-1312 | 346 | AAGGGCTTGGCTTAATTA | refseqGeneIntron-annotate |
| CU-1255 | 347 | AACCCGGAAGGCGGAGGTTGCGG | computGene-annotate;refseqGeneIntron-annotate |

TABLE 7-continued (PART A) List of known and newly identified bona fide and candidate mature miRNAs and their predicted precursors. Genomic locations are provided for all candidate miRNA. Frequencies have been calculated only for bonafide miRNA (cloned at least 2 times in the B cell libraries).

| ID | SEQ ID NO. | Mature miRNA sequence | Annotations |
|---|---|---|---|
| CU-1346 | 349 | CAAAAGCTTCTTTGACGTCCCATCCAC | refseqGeneIntron-annotate |
| CU-1573 | 359 | TGCCGTGATCGTATAGTGGTTA | piRNA-annotate |
| CU-1395 | 362 | CTGACAGCCGGGGTTTTGGA | computGene-annotate |
| CU-1365 | 363 | CGGCGGGGCCTGGAGTCTG | mRNAall-annotate;computGene-annotate;exEID-annotate |
| CU-1375 | 364 | CCTGGCTCGCTGCGCCA | computGene-annotate |
| CU-1209 | 207 | CCTCACCTGGAGCACCA | tRNAprefix-annotate; |
| CU-1174 | 366 | CCCGAACGCTGCCAACCC | exEID-annotate |
| CU-1214 | 215 | CCCCAGTACCTCCACCA | tRNAprefix-annotate; |
| CU-1218 | 223 | ATCCTGTTCGTGACGCCA | tRNAprefix-annotate; |
| CU-1385 | 367 | AGACCCGCGGGCGCTCTCCAGTC | rnaGene-annotate |

TABLE 7

(PART B) List of known and newly identified bona fide and candidate mature miRNAs. Counts and annotations are provided for all candidate miRNA. Frequencies have been calculated only for bona fide miRNA (cloned at least 2 times in the B cell libraries).

| | | Corrected Counts | | | | Frequencies | | | |
|---|---|---|---|---|---|---|---|---|---|
| Mature miRNA sequence | SEQ ID NO. | Naïve (N) | Memory (M) | Centroblasts (CB) | Ramos (RA) | Naïve (N) | Memory (M) | Centroblasts (CB) | Ramos (RA) |
| TGTAGTGTTTCCTACTTTATGGA | 1 | 1329 | 592 | 635 | 391 | 40.74 | 21.5 | 25.55 | 17.89 |
| TAGCTTATCAGACTGATGTTGA | 2 | 196 | 353 | 144 | 13 | 6.01 | 12.82 | 5.79 | 0.59 |
| TAAAGTGCTTATAGTGCAGGTAG | 3 | 54 | 19 | 49.82 | 257.89 | 1.66 | 0.69 | 2 | 11.8 |
| TAGCAGCACATCATGGTTTACA | 4 | 38 | 61 | 176.84 | 105 | 1.16 | 2.21 | 7.12 | 4.8 |
| TAGCAGCACGTAAATATTGGCG | 5 | 131 | 97 | 53 | 35 | 4.02 | 3.52 | 2.13 | 1.6 |
| TGAGGTAGTAGGTTGTATAGTT | 6 | 62.84 | 78.99 | 92.19 | 63.25 | 1.93 | 2.87 | 3.71 | 2.89 |
| TATTGCACTTGTCCCGGCCTGT | 7 | 17 | 21 | 46 | 207 | 0.52 | 0.76 | 1.85 | 9.47 |
| TCCCACCGCTGCCACCA | 8 | 68 | 97 | 25 | 28 | 2.08 | 3.52 | 1.01 | 1.28 |
| TGAGGTAGTAGATTGTATAGTT | 9 | 41.28 | 44 | 64 | 51.38 | 1.27 | 1.6 | 2.58 | 2.35 |
| TAGCACCATCTGAAATCGGTTA | 10 | 78 | 60 | 42 | 22 | 2.39 | 2.18 | 1.69 | 1.01 |
| TAGCAGCACATAATGGTTTGT | 11 | 90 | 39 | 32.16 | 8 | 2.76 | 1.42 | 1.29 | 0.37 |
| CCCATAAAGTAGAAAGCACTA | 12 | 88 | 53 | 7 | 10 | 2.7 | 1.92 | 0.28 | 0.46 |
| TGAGGTAGTAGTTTGTACAGTT | 13 | 41.28 | 47 | 30.77 | 21.16 | 1.27 | 1.71 | 1.24 | 0.97 |
| TGAGGTAGTAGTTTGTGCTGTT | 14 | 23 | 24 | 32 | 42 | 0.71 | 0.87 | 1.29 | 1.92 |
| TAGCACCATTTGAAATCGGTTA | 15 | 44 | 41 | 16 | 1 | 1.35 | 1.49 | 0.64 | 0.05 |
| TGTAAACATCCTACACTCTCAGC | 16 | 27 | 25 | 26 | 20 | 0.83 | 0.91 | 1.05 | 0.91 |
| CAAAGTGCTTACAGTGCAGGTAG | 17 | 9 | 6 | 10.18 | 65.04 | 0.28 | 0.22 | 0.41 | 2.98 |
| CATTGCACTTGTCTCGGTCTGA | 18 | 11 | 9 | 34 | 39 | 0.34 | 0.33 | 1.37 | 1.78 |
| CAACGGAATCCCAAAAGCAGCTG | 19 | 17 | 21 | 36 | 18 | 0.52 | 0.76 | 1.45 | 0.82 |

TABLE 7-continued (PART B) List of known and newly identified bona fide and candidate mature miRNAs. Counts and annotations are provided for all candidate miRNA. Frequencies have been calculated only for bona fide miRNA (cloned at least 2 times in the B cell libraries).

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| TGTGCAAATCCATGCAAAACTGA | 20 | 0 | 1 | 25 | 65 | 0 | 0.04 | 1.01 | 2.97 |
| TACCACAGGGTAGAACCACGGA | 21 | 31 | 22 | 17 | 21 | 0.95 | 0.8 | 0.68 | 0.96 |
| TGTAAACATCCTACACTCAGCT | 22 | 31 | 11 | 27 | 16 | 0.95 | 0.4 | 1.09 | 0.73 |
| TGAGGTAGTAGGTTGTGTGGTT | 23 | 19.48 | 19 | 29 | 5.08 | 0.6 | 0.69 | 1.17 | 0.23 |
| TAGCACCATTTGAAATCAGTGTT | 24 | 22 | 14 | 12 | 4 | 0.67 | 0.51 | 0.48 | 0.18 |
| TAAAGTGCTGACAGTGCAGAT | 25 | 7 | 6 | 13 | 26 | 0.21 | 0.22 | 0.52 | 1.19 |
| TCCCTGTCCTCCAGGAGCTC | 26 | 6 | 3 | 3 | 32 | 0.18 | 0.11 | 0.12 | 1.46 |
| TTCAAGTAATCCAGGATAGGCT | 27 | 2 | 8 | 13 | 16 | 0.06 | 0.29 | 0.52 | 0.73 |
| CAAAGTGCTGTTCGTGCAGGTAG | 28 | 9 | 2 | 13 | 14 | 0.28 | 0.07 | 0.52 | 0.64 |
| TGTCAGTTTGTCAAATACCCCA | 29 | 25 | 10 | 1 | 0 | 0.77 | 0.36 | 0.04 | 0 |
| TGAGAACTGAATTCCATGGGTT | 30 | 4 | 7 | 21 | 4 | 0.12 | 0.25 | 0.85 | 0.18 |
| TCTCCCAACCCTTGTACCAGT | 31 | 12 | 18 | 2 | 0 | 0.37 | 0.65 | 0.08 | 0 |
| TCCCTGAGACCCTAACTTGTGA | 32 | 0 | 1 | 28 | 2 | 0 | 0.04 | 1.13 | 0.09 |
| TCTCACACAGAAATCGCACCCGTC | 33 | 10 | 8 | 8 | 3 | 0.31 | 0.29 | 0.32 | 0.14 |
| GTCCCTGTTCGGGCGCCA | 34 | 12 | 10 | 6 | 1 | 0.37 | 0.36 | 0.24 | 0.05 |
| TGTGCAAATCTATGCAAAACTGA | 35 | 0 | 0 | 9 | 19 | 0 | 0 | 0.36 | 0.87 |
| TGTAAACATCCCCGACTGGAAG | 36 | 7 | 3 | 14 | 3 | 0.21 | 0.11 | 0.56 | 0.14 |
| AGCTACATTGTCTGCTGGGTT | 37 | 17 | 6 | 4 | 0 | 0.52 | 0.22 | 0.16 | 0 |
| AGAGGTAGTAGGTTGCATAGTT | 38 | 2 | 4 | 10 | 10 | 0.06 | 0.15 | 0.4 | 0.46 |
| CCGCACTGTGGGTACTTGCT | 39 | 8 | 6 | 2 | 8 | 0.25 | 0.22 | 0.08 | 0.37 |
| AGCAGCATTGTACAGGGCTATGA | 40 | 1 | 1 | 10 | 11 | 0.03 | 0.04 | 0.4 | 0.5 |
| AACTGGCCCTCAAAGTCCCGCT | 41 | 0 | 0 | 2 | 21 | 0 | 0 | 0.08 | 0.96 |
| GCCCCTGGGCCTATCCTAGAA | 42 | 1 | 0 | 10 | 10 | 0.03 | 0 | 0.4 | 0.46 |
| AGCTGGTGTTGTGAATCAGGCCGT | 43 | 0 | 0 | 15 | 5 | 0 | 0 | 0.6 | 0.23 |
| TGAGGGGCAGAGAGCGAGACTT | 44 | 5 | 1 | 7 | 4 | 0.15 | 0.04 | 0.28 | 0.18 |
| AGCTACATCTGGCTACTGGGTCT | 45 | 6 | 6 | 5 | 0 | 0.18 | 0.22 | 0.2 | 0 |
| GTGGGGAGAGGCTGTA | 46 | 2 | 6 | 3 | 5 | 0.06 | 0.22 | 0.12 | 0.23 |
| CTATACGACCTGCTGCCTTTC | 47 | 6 | 3 | 4 | 1 | 0.18 | 0.11 | 0.16 | 0.05 |
| TTAATGCTAATCGTGATAGGGGT | 48 | 3 | 4 | 5 | 1 | 0.09 | 0.15 | 0.2 | 0.05 |
| AGGGGGAAAGTTCTATAGTC | 49 | 0 | 2 | 0 | 11 | 0 | 0.07 | 0 | 0.5 |
| ACAGTAGTCTGCACATTGGTT | 50 | 0 | 0 | 13 | 0 | 0 | 0 | 0.52 | 0 |
| AACATTCAACGCTGTCGGTGAGTT | 51 | 0 | 0 | 7 | 6 | 0 | 0 | 0.28 | 0.27 |
| TGGAAGACTAGTGATTTTGTTGT | 52 | 1 | 1 | 1 | 8 | 0.03 | 0.04 | 0.04 | 0.37 |
| TAATGCCCCTAAAAATCCTTAT | 53 | 0 | 0 | 6 | 4 | 0 | 0 | 0.24 | 0.18 |
| TAGCAGCACAGAAATATTGGCA | 54 | 4 | 0 | 5 | 0 | 0.12 | 0 | 0.2 | 0 |

TABLE 7-continued (PART B) List of known and newly identified bona fide and candidate mature miRNAs. Counts and annotations are provided for all candidate miRNA. Frequencies have been calculated only for bona fide miRNA (cloned at least 2 times in the B cell libraries).

| | | Corrected Counts | | | | Frequencies | | | |
|---|---|---|---|---|---|---|---|---|---|
| Mature miRNA sequence | SEQ ID NO. | Naïve (N) | Memory (M) | Centroblasts (CB) | Ramos (RA) | Naïve (N) | Memory (M) | Centroblasts (CB) | Ramos (RA) |
| TGAGGTAGTAGGTTGTAT | 55 | 0.11 | 0.01 | 0.01 | 0.13 | 0 | 0 | 0 | 0.01 |
| TCCTGTACTGAGCTGCCCCGAG | 56 | 0 | 0 | 7 | 1 | 0 | 0 | 0.28 | 0.05 |
| TCCCTGAGACCCTTTAACCTGTGA | 57 | 0 | 0 | 8 | 0 | 0 | 0 | 0.32 | 0 |
| ATCACATTGCCAGGGATTTCCA | 58 | 0 | 0.5 | 7 | 0 | 0 | 0.02 | 0.28 | 0 |
| TCACAGTGAACCGGTCTCTTT | 59 | 1 | 0 | 0 | 6 | 0.03 | 0 | 0 | 0.27 |
| CACTAGATTGTGAGCTCCTGGA | 60 | 2 | 0 | 4 | 1 | 0.06 | 0 | 0.16 | 0.05 |
| CAACAAATCACAGTCTGCCAT | 61 | 3 | 0 | 1 | 3 | 0.09 | 0 | 0.04 | 0.14 |
| CAAAGTGCTTATAGTGCAGGTAG | 62 | 0 | 1 | 1 | 0.08 | 0 | 0.04 | 0.04 | 0 |
| AGGTTGGGATCGGTTGCAATGCT | 63 | 0 | 0 | 0 | 7 | 0 | 0 | 0 | 0.32 |
| ACATTCATTGCTGTCGGTGGGTT | 64 | 0 | 0 | 1 | 6 | 0 | 0 | 0.04 | 0.27 |
| AATGACACGATCACTCCCGTTGAG | 1095 | 0 | 0 | 7 | 0 | 0 | 0 | 0.28 | 0 |
| TCCCCCAGGTGTGATTCTGATT | 65 | 4 | 1 | 0 | 1 | 0.12 | 0.04 | 0 | 0.05 |
| CCCAGTGTTCAGACTACCTGTTC | 66 | 0 | 0 | 6 | 0 | 0 | 0 | 0.24 | 0 |
| ACCAATATTACTGTGCTGCTT | 67 | 1 | 1 | 2 | 2 | 0.03 | 0.04 | 0.08 | 0.09 |
| TGTAAACATCCTTGACTGGAAGCT | 68 | 2 | 0 | 3 | 0 | 0.06 | 0 | 0.12 | 0 |
| TAAGGTGCATCTAGTGCAGATA | 69 | 0 | 0 | 1 | 4 | 0 | 0 | 0.04 | 0.18 |
| ATCACATTGCCAGGGATTACCA | 70 | 0 | 0.5 | 3 | 1 | 0 | 0.02 | 0.12 | 0.05 |
| ACTGCCCTAAGTGCTCCTTCTG | 71 | 0 | 0 | 0 | 5 | 0 | 0 | 0 | 0.23 |
| TGTAAACATCCTCGACTGGA | 72 | 1 | 0 | 3 | 0 | 0.03 | 0 | 0.12 | 0 |
| TACAGTACTGTGATAACTGAAG | 73 | 1 | 0 | 0 | 3 | 0.03 | 0 | 0 | 0.14 |
| CTAGACTGAAGCTCCTTGAGG | 74 | 2 | 1 | 1 | 0 | 0.06 | 0.04 | 0.04 | 0 |
| TGGGTTGAGAGGGCGAA | 1094 | 1 | 0 | 1 | 1 | 0.03 | 0 | 0.04 | 0.05 |
| TGGCAGTGTCTTAGCTGGTTGTT | 75 | 0 | 1 | 2 | 0 | 0 | 0.04 | 0.08 | 0 |
| TGAGGTAGTAAGTTGTATTGTT | 76 | 0 | 1 | 1 | 1 | 0 | 0.04 | 0.04 | 0.05 |
| TGAGAACTGAATTCCATAGGCTGT | 77 | 1 | 0 | 2 | 0 | 0.03 | 0 | 0.08 | 0 |
| TCGAGGAGCTCACAGTCTAGTA | 78 | 1 | 0 | 1 | 1 | 0.03 | 0 | 0.04 | 0.05 |
| AGCTCGGTCTGAGGCCCCTCAG | 79 | 0 | 0 | 2 | 1 | 0 | 0 | 0.08 | 0.05 |
| ACTGCAGTGAAGGCACTTGTAG | 80 | 0 | 0 | 0 | 3 | 0 | 0 | 0 | 0.14 |
| ACCATCGACCGTTGATTGTA | 81 | 0 | 1 | 0 | 2 | 0 | 0.04 | 0 | 0.09 |
| TTCACCACCTTCTCCACCCAG | 82 | 0 | 0 | 0 | 2 | 0 | 0 | 0 | 0.09 |
| TTCACAGTGGCTAAGTTCTG | 83 | 0 | 0 | 2 | 0 | 0 | 0 | 0.08 | 0 |
| TTCAAGTAATTCAGGATAGGTT | 84 | 0 | 0 | 1 | 1 | 0 | 0 | 0.04 | 0.05 |
| TGGGTTTACGTTGGGAGAACT | 85 | 0 | 0 | 0 | 2 | 0 | 0 | 0 | 0.09 |
| TGAGGTAGGAGGTTGTATAGTT | 87 | 0 | 0 | 1.02 | 0 | 0 | 0 | 0.04 | 0 |
| TGACCGATTTCTCCTGGTGTT | 88 | 2 | 0 | 0 | 0 | 0.06 | 0 | 0 | 0 |
| TATTGCACTCGTCCCGGCC | 89 | 0 | 0 | 1 | 1 | 0 | 0 | 0.04 | 0.05 |

TABLE 7-continued (PART B) List of known and newly identified bona fide and candidate mature miRNAs. Counts and annotations are provided for all candidate miRNA. Frequencies have been calculated only for bona fide miRNA (cloned at least 2 times in the B cell libraries).

| Mature miRNA sequence | SEQ ID NO. | Corrected Counts | | | | Frequencies | | | |
| --- | --- | --- | --- | --- | --- | --- | --- | --- | --- |
| | | Naïve (N) | Memory (M) | Centroblasts (CB) | Ramos (RA) | Naïve (N) | Memory (M) | Centroblasts (CB) | Ramos (RA) |
| GGGGTGCTATCTGTGATTGA | 90 | 2 | 0 | 0 | 0 | 0.06 | 0 | 0 | 0 |
| GCATGGGTGGTTCAGTGGTAGAA | 91 | 0 | 0 | 2 | 0 | 0 | 0 | 0.08 | 0 |
| CTGGCCCTCTCTGCCCTT | 92 | 0 | 0 | 1 | 1 | 0 | 0 | 0.04 | 0.05 |
| CTGACCTATGAATTGACAGC | 93 | 0 | 0 | 0 | 2 | 0 | 0 | 0 | 0.09 |
| CTCCTGACTCCAGGTCCTGTG | 94 | 0 | 0 | 0 | 2 | 0 | 0 | 0 | 0.09 |
| CGTCAACACTTGCTGGTT | 95 | 0 | 0 | 1 | 1 | 0 | 0 | 0.04 | 0.05 |
| CGAATCATTATTTGCTGCTCT | 96 | 0 | 0 | 1 | 1 | 0 | 0 | 0.04 | 0.05 |
| CATCGGGAATGTCGTGTCCGCC | 97 | 0 | 2 | 0 | 0 | 0.07 | 0 | 0 | |
| CAGTGGTTTTACCCTATGGTA | 98 | 0 | 0 | 1 | 1 | 0 | 0 | 0.04 | 0.05 |
| CAGTGCAATGATGAAAGGGCAT | 99 | 0 | 0 | 2 | 0 | 0 | 0 | 0.08 | 0 |
| CAGCAGCACACTGTGGTTTGT | 100 | 0 | 0 | 2 | 0 | 0 | 0 | 0.08 | 0 |
| CACGCTCATGCACACACCCAC | 101 | 0 | 0 | 2 | 0 | 0 | 0 | 0.08 | 0 |
| AAGGAGCTCACAGTCTATTGAG | 102 | 0 | 0 | 2 | 0 | 0 | 0 | 0.08 | 0 |
| GCCGGGTACTTTCGTATTTT | 131 | 3 | 3 | 0 | 34 | 0.09 | 0.11 | 0 | 1.56 |
| GCTAAGGAAGTCCTGTGCTCAGTTTT | 132 | 0 | 0 | 1 | 19 | 0 | 0 | 0.04 | 0.87 |
| AGGGTGTGCGTGTTTTT | 148 | 0 | 0 | 0 | 20 | 0 | 0 | 0 | 0.91 |
| GAGAGCGCTCGGTTTTT | 150 | 0 | 0 | 1 | 9 | 0 | 0 | 0.04 | 0.41 |
| TGGTGTGGTCTGTTGTTTT | 151 | 0 | 0 | 0 | 9 | 0 | 0 | 0 | 0.41 |
| TGTGCTCCGGAGTTACCTCGTTT | 152 | 0 | 0 | 0 | 8 | 0 | 0 | 0 | 0.37 |
| AACCGAGCGTCCAAGCTCTTTCCATTTT | 155 | 0 | 0 | 0 | 5 | 0 | 0 | 0 | 0.23 |
| TCCCCGCACCTCCACCA | 156 | 0 | 2 | 1 | 1 | 0 | 0.07 | 0.04 | 0.05 |
| GGCGTGATTCATACCTTTT | 162 | 0 | 0 | 0 | 2 | 0 | 0 | 0 | 0.09 |
| ATGTGGTGGCTTACTTTT | 169 | 0 | 0 | 0 | 2 | 0 | 0 | 0 | 0.09 |
| AGAAAGGCCGAATTTTA | 172 | 0 | 0 | 1 | 1 | 0 | 0 | 0.04 | 0.05 |
| TCCCCGGCACTTCCACCA | 157 | 0 | 3 | 0 | 0 | 0 | 0.11 | 0 | 0 |
| CCCACCCAGGGACGCCA | 232 | 223 | 218 | 6 | 2 | 6.84 | 7.92 | 0.24 | 0.09 |
| TCCCCGGCACCTCCACCA | 233 | 60.47 | 101.82 | 40.28 | 34 | 1.85 | 3.7 | 1.62 | 1.56 |
| ATCCCGGACGAGCCCCCA | 234 | 48 | 60 | 80 | 45 | 1.47 | 2.18 | 3.22 | 2.06 |
| CCCCCCACTGCTAAATTTGACTGGCTT | 142 | 18 | 8 | 61 | 22 | 0.55 | 0.29 | 2.45 | 1.01 |
| TCGATTCCCGGCCAATGCACCA | 236 | 4 | 18 | 36 | 4 | 0.12 | 0.65 | 1.45 | 0.18 |
| ATCCCACTTCTGACACCA | 237 | 11 | 9 | 26.69 | 14 | 0.34 | 0.33 | 1.07 | 0.64 |
| TCCCCGTACGGGCCACCA | 239 | 11 | 6 | 3 | 2 | 0.34 | 0.22 | 0.12 | 0.09 |
| AGTCCCATCTGGGTCGCCA | 243 | 4 | 2 | 3 | 6 | 0.12 | 0.07 | 0.12 | 0.27 |

TABLE 7-continued (PART B) List of known and newly identified bona fide and candidate mature miRNAs. Counts and annotations are provided for all candidate miRNA. Frequencies have been calculated only for bona fide miRNA (cloned at least 2 times in the B cell libraries).

| Mature miRNA sequence | SEQ ID NO. | Corrected Counts | | | | Frequencies | | | |
|---|---|---|---|---|---|---|---|---|---|
| | | Naïve (N) | Memory (M) | Centroblasts (CB) | Ramos (RA) | Naïve (N) | Memory (M) | Centroblasts (CB) | Ramos (RA) |
| CCCCCCACTGCTAAATTTGACTGGA | 244 | 1 | 1 | 6 | 2 | 0.03 | 0.04 | 0.24 | 0.09 |
| GTCCCTTCGTGGTCGCCA | 246 | 1 | 2 | 1 | 2 | 0.03 | 0.07 | 0.04 | 0.09 |
| TCCTCACACGGGGCACCA | 248 | 2 | 1 | 2 | 0 | 0.06 | 0.04 | 0.08 | 0 |
| TAACGGCCGCGGTACCC | 249 | 0 | 3 | 1 | 0 | 0 | 0.11 | 0.04 | 0 |
| GAGGGGGACCAAAAAAAA | 250 | 0 | 0 | 0 | 4 | 0 | 0 | 0 | 0.18 |
| CCCGGGTTTCGGCACCA | 133 | 0 | 3 | 0 | 1 | 0 | 0.11 | 0 | 0.05 |
| ATAGGTTTGGTCCTAGCCTTTCT | 354 | 0 | 0 | 3 | 1 | 0 | 0 | 0.12 | 0.05 |
| AGGGGGGTAAAAAAAAA | 252 | 0 | 0 | 0 | 4 | 0 | 0 | 0 | 0.18 |
| GAGCCATGATGATACCACTGAGC | 254 | 0 | 1 | 0 | 2 | 0 | 0.04 | 0 | 0.09 |
| AGAACACTACGAGCCACA | 257 | 3 | 0 | 0 | 0 | 0.09 | 0 | 0 | 0 |
| ACCCCACTTCTGGTACCA | 258 | 0 | 0 | 1 | 2 | 0 | 0 | 0.04 | 0.09 |
| TCTCGGTGGAACCTCCA | 260 | 0 | 0 | 1 | 1 | 0 | 0 | 0.04 | 0.05 |
| TACCGAGCCTGGTGATAGC | 262 | 0 | 1 | 1 | 0 | 0 | 0.04 | 0.04 | 0 |
| GCAGCGCCAGCCTCCCGCCCTAC | 263 | 2 | 0 | 0 | 0 | 0.06 | 0 | 0 | 0 |
| ATCCCCAGCACCTCCACCA | 265 | 0 | 0 | 0 | 2 | 0 | 0 | 0 | 0.09 |
| AGCAGTGATGTCCTGAAAATTCTGAAG | 266 | 0 | 0 | 0 | 2 | 0 | 0 | 0 | 0.09 |
| ACCCCACTATGCTTAGCCCT | 267 | 0 | 0 | 2 | 0 | 0 | 0 | 0.08 | 0 |
| AAAGGACCTGGCGGTGCTTC | 268 | 1 | 0 | 1 | 0 | 0.03 | 0 | 0.04 | 0 |
| TCCCCGGCATCTCCACCA | 350 | 116.53 | 75.18 | 104.72 | 59 | 3.57 | 9.99 | 4.21 | 2.7 |
| GCCCGCATCCTCCACCA | 143 | 38 | 61 | 2 | 4 | 1.16 | 2.21 | 0.08 | 0.18 |
| ATCCCACTCCTGACACCA | 145 | 7 | 13 | 11.31 | 3 | 0.21 | 0.47 | 0.46 | 0.14 |
| TCGATTCCCGGCCCATGCACCA | 149 | 1 | 2 | 10 | 4 | 0.03 | 0.07 | 0.4 | 0.18 |
| TCCCCGACACCTCCACCA | 153 | 2 | 2 | 2 | 1 | 0.06 | 0.07 | 0.08 | 0.05 |
| TCTAGAGGAGCCTGTTCTGTA | 352 | 0 | 1 | 3 | 0 | 0 | 0.04 | 0.12 | 0 |
| TCGATTCCCGGTCAGGGAACCA | 353 | 0 | 0 | 0 | 4 | 0 | 0 | 0 | 0.18 |
| TCACCCCATAAACACCA | 158 | 2 | 1 | 0 | 0 | 0.06 | 0.04 | 0 | 0 |
| CGTTCGCGCTTTCCCCTG | 355 | 0 | 1 | 2 | 0 | 0 | 0.04 | 0.08 | 0 |
| TTCCCCGACGGGGAGCCA | 161 | 1 | 0 | 0 | 1 | 0.03 | 0 | 0 | 0.05 |
| TAAGTGTTTGTGGGTTA | 356 | 1 | 1 | 0 | 0 | 0.03 | 0.04 | 0 | 0 |
| ATCCCCAGCATCTCCACCA | 171 | 0 | 0 | 2 | 0 | 0 | 0 | 0.08 | 0 |
| CCCCCACAACCGCGCTTGACTAGC | 368 | 12 | 11 | 7 | 9 | 0.37 | 0.4 | 0.28 | 0.41 |
| CCCTGCTCGCTGCGCCA | 369 | 7 | 20 | 5 | 1 | 0.21 | 0.73 | 0.2 | 0.05 |
| CTCCCACTGCTTCACTTGACTAGC | 370 | 2 | 2 | 18 | 9 | 0.06 | 0.07 | 0.72 | 0.41 |
| TCACGTCGGGGTCACCA | 372 | 16 | 4 | 5 | 1 | 0.49 | 0.15 | 0.2 | 0.05 |

TABLE 7-continued (PART B) List of known and newly identified bona fide and candidate mature miRNAs. Counts and annotations are provided for all candidate miRNA. Frequencies have been calculated only for bona fide miRNA (cloned at least 2 times in the B cell libraries).

| | | Corrected Counts | | | | Frequencies | | | |
|---|---|---|---|---|---|---|---|---|---|
| Mature miRNA sequence | SEQ ID NO. | Naïve (N) | Memory (M) | Centroblasts (CB) | Ramos (RA) | Naïve (N) | Memory (M) | Centroblasts (CB) | Ramos (RA) |
| TCCCTGGTGGTCTAGTGGTTAGGATTCG | 373 | 0 | 1 | 10 | 6 | 0 | 0.04 | 0.4 | 0.27 |
| TCCTGCCGCGGTCGCCA | 375 | 6 | 8 | 0 | 1 | 0.18 | 0.29 | 0 | 0.05 |
| GGAGAGAACGCGGTCTGAGTGGT | 376 | 3 | 7 | 1 | 0 | 0.09 | 0.25 | 0.04 | 0 |
| TCGGGTGCGAGAGGTCCCGGGT | 377 | 0 | 0 | 0 | 10 | 0 | 0 | 0 | 0.46 |
| GGCTGGTCCGATGGTAGTGGGTT | 378 | 4 | 3 | 3 | 0 | 0.12 | 0.11 | 0.12 | 0 |
| CGGAAGCGTGCTGGGCCC | 379 | 1 | 5 | 0 | 4 | 0.03 | 0.18 | 0 | 0.18 |
| GCGGGTGATGCGAACTGGAGTCTGAGC | 381 | 0 | 0 | 6 | 1 | 0 | 0 | 0.24 | 0.05 |
| GACGAGGTGGCCGAGTGG | 382 | 2 | 3 | 2 | 0 | 0.06 | 0.11 | 0.08 | 0 |
| CTGATTGCTCCTGTCTGATT | 351 | 0 | 0 | 6 | 1 | 0 | 0 | 0.24 | 0.05 |
| CTCCTGGCTGGCTCGCCA | 384 | 0 | 0 | 3 | 3 | 0 | 0 | 0.12 | 0.14 |
| GGCTGGTCCGAGTGCAGTGGTGTTTA | 386 | 0 | 1 | 4 | 0 | 0 | 0.04 | 0.16 | 0 |
| CTGCTGTGATGACATTC | 387 | 1 | 2 | 2 | 0 | 0.03 | 0.07 | 0.08 | 0 |
| TCCTCGTTAGTATAGTGGTGAGTATCCC | 389 | 0 | 1 | 3 | 0 | 0 | 0.04 | 0.12 | 0 |
| GCATTGGTGGTTCAGTGGTAGA | 391 | 0 | 0 | 3 | 1 | 0 | 0 | 0.12 | 0.05 |
| TTCTCACTACTGCACTTGACTA | 395 | 0 | 0 | 2 | 1 | 0 | 0 | 0.08 | 0.05 |
| TGGTTATCACGTTCGCC | 396 | 0 | 2 | 0 | 1 | 0 | 0.07 | 0 | 0.05 |
| TAGGGGTATGATTCTCGCT | 397 | 1 | 0 | 0 | 2 | 0.03 | 0 | 0 | 0.09 |
| CGTCCATGATGTTCCGCAA | 255 | 1 | 0 | 2 | 0 | 0.03 | 0 | 0.08 | 0 |
| CCACGAGGAAGAGAGGTAGC | 398 | 2 | 1 | 0 | 0 | 0.06 | 0.04 | 0 | 0 |
| TGTATTGTGAGACATTC | 259 | 0 | 1 | 1 | 0 | 0 | 0.04 | 0.04 | 0 |
| GTCAGGATGGCCGAGCGGTCT | 399 | 0 | 1 | 1 | 0 | 0 | 0.04 | 0.04 | 0 |

A sizeable number of sequences (334) aligned to genomic regions that did not fulfill the criteria for miRNA precursors (FIG. 24). About 80% of these sequences were annotated or cloned only once and may represent degradation products originating from other RNA species (FIG. 24 and Table 8). The remaining (58 sequences), however, mapped to genomic regions that lack annotations and may therefore represent a part of the transcriptome whose functions are unknown (Table 9 and Table 10). Interestingly, several of these nonannotated sequences (i.e., CU-5004, CU-5021, CU-6030, CU-6069) were cloned multiple times and showed differential expression across libraries (Table 9 and Table 10), suggesting that they may represent short RNAs with characteristics distinct from those currently recognized in "classic" miRNAs.

In conclusion, the generation of short-RNA libraries from normal and neoplastic B cells led to the identification of 178 mature miRNAs cloned multiple times as well as other short-RNA species of unknown function.

TABLE 8

Characterization of short-RNA libraries. Number of not redundant short-RNAs cloned in each library (naïve B cells, memory B cells, centroblasts and Ramos cell line) and overall (total). Each short-RNA is annotated according to the listed RNA species. Results shown here refer only to short-RNA with matches to the human genome. The same short-RNA might match to multiple databases and therefore the overall sum does not correspond to the total number of short-RNAs.

| RNA species | Naïve | Memory | Centroblasts | Ramos | Total |
|---|---|---|---|---|---|
| Total (non redundant) | 680 | 709 | 740 | 740 | 2086 |
| miRNA | 424 | 408 | 528 | 538 | 1259 |
| miRNA other* | 1 | 0 | 3 | 0 | 4 |
| tRNA | 27 | 33 | 32 | 29 | 108 |
| rRNA | 61 | 99 | 34 | 16 | 174 |
| mRNA | 76 | 72 | 25 | 34 | 176 |
| snoRNA | 8 | 13 | 15 | 6 | 40 |
| yRNA | 11 | 11 | 31 | 21 | 53 |
| piRNA | 46 | 54 | 70 | 62 | 148 |
| Repeats | 1 | 1 | 0 | 1 | 2 |

TABLE 8-continued

Characterization of short-RNA libraries. Number of not redundant short-RNAs cloned in each library (naïve B cells, memory B cells, centroblasts and Ramos cell line) and overall (total). Each short-RNA is annotated according to the listed RNA species. Results shown here refer only to short-RNA with matches to the human genome. The same short-RNA might match to multiple databases and therefore the overall sum does not correspond to the total number of short-RNAs.

| RNA species | Naïve | Memory | Centroblasts | Ramos | Total |
|---|---|---|---|---|---|
| Mitochondrial genome | 12 | 36 | 54 | 11 | 101 |
| Human viruses | 1 | 4 | 0 | 0 | 5 |
| E. Coli | 5 | 4 | 0 | 0 | 7 |
| Not Annotated | 111 | 119 | 97 | 134 | 375 |

*miRNA other: includes fragments of miRNA precursors, not mature.
The databases used in this analysis are detailed in Supplementary Methods.

TABLE 9

(PART A) List of short-RNA lacking genomic locations with appropriate RNA secondary structures to be defined miRNAs. Table includes information on genomic locations and annotations.

| ID | SEQ ID NO: | Short-RNA sequence | Annotations |
|---|---|---|---|
| CU-5004 | 1096 | GAAGCGGGTGCTCTTATTTT | NEW |
| CU-5008 | 1097 | GTGTAAGCAGGGTCGTTTT | NEW |
| CU-6003 | 1098 | ATCCCACCGCTGCTACCA | NEW |
| CU-5023 | 1099 | GGGAAGGTGACCTGAC | NEW |
| CU-5007 | 1100 | CTCCCGCCTTTTTTCCC | NEW |
| CU-5024 | 1101 | CGGAGCAAGAGCGT | NEW |
| CU-5026 | 1102 | CCCCCGGCACCATCAATA | NEW |
| CU-5027 | 1103 | CAGCCTAGCCCCTACCC | NEW |
| CU-5005 | 1104 | CAGAAGGTCTCACTTTT | NEW |
| CU-5006 | 1105 | AGTATTCTCTGTGGCTTT | NEW |
| CU-5028 | 1106 | TGGAGTGACTATATGGATGCCCCC | NEW |
| CU-5029 | 1107 | TCTGATAGCTTACTTT | NEW |
| CU-5030 | 1108 | TCGAGCCCCAGTGGAACCAC | NEW |
| CU-5032 | 1109 | TCCTCCCCACACTCATCGCCCTTACCA | NEW |
| CU-5033 | 1110 | TATACTACAAGGACACCA | NEW |
| CU-5034 | 1111 | TAGTGGGTGAAAAAAAAAAA | NEW |
| CU-5035 | 1112 | TACCACACATTCGAAGAACCCGTA | NEW |
| CU-5036 | 1113 | TACAAAACCCACCCCATTCCTCCCCA | NEW |
| CU-5019 | 1114 | GGAGGGGGGTAAAAAAA | NEW |
| CU-5037 | 1115 | GCCCTCCTAATGACCTCC | NEW |
| CU-5038 | 1116 | CTTCCCTCTACACTTATCATC | NEW |
| CU-5039 | 1117 | CGGGCGGCCTGCGCTCTCA | NEW |
| CU-5040 | 1118 | CCCGAGGCCGTGTGCAAATGCAT | NEW |
| CU-5020 | 1119 | CCCCGGCATCTCCACC | NEW |
| CU-5041 | 1120 | CCCCCAGTACCTCCACCA | NEW |
| CU-5042 | 1121 | CCCCCACTGCTAAACTTGACTGGCTTT | NEW |
| CU-5043 | 1122 | CCCACTCCACCTTACTACCA | NEW |

TABLE 9-continued (PART A) List of short-RNA lacking genomic locations with appropriate RNA secondary
structures to be defined miRNAs.
Table includes information on genomic locations and annotations.

| ID | SEQ ID NO: | Short-RNA sequence | Annotations |
|---|---|---|---|
| CU-5044 | 1123 | CCCAAGAACAGGGTGACCA | NEW |
| CU-5045 | 1124 | CCAGTCGCGGCCAAATCA | NEW |
| CU-5046 | 1125 | CCAGCTTCACCAAGGTATTGGTTA | NEW |
| CU-5047 | 1126 | CCAGAAAAAACAGGCCTC | NEW |
| CU-5048 | 1127 | CATCATAATCGGAGGCTTTGGCAAC | NEW |
| CU-5049 | 1128 | CAGCAGGGGTAATAAGTGAAATCAAA | NEW |
| CU-5050 | 1129 | CAATGGTGCAGCCGCTATTAAAGGTTCA | NEW |
| CU-5051 | 1130 | CAACTCCTACATACTTCCCCC | NEW |
| CU-5053 | 1131 | ATGCATCTCATATGCGAATAGGAATGC | NEW |
| CU-5054 | 1132 | ATCCCACTTCTGTACCA | NEW |
| CU-5055 | 1133 | ATAACACTAGAAAGTTGGGGCAGATTGC | NEW |
| CU-5056 | 1134 | ACGTGGGCACATTACCCGTCTGACCTGA | NEW |
| CU-5057 | 1135 | ACCCCTTATTAACCCA | NEW |
| CU-5058 | 1136 | ACAAGGCACACCTACACCCCTTATCCC | NEW |
| CU-5059 | 1137 | AAAAGACACCCCCCCACCA | NEW |
| CU-5060 | 1138 | AAAACCCCTACGCATTTATAT | NEW |
| CU-5061 | 1139 | AAAAAGACACCCCCCACCA | NEW |
| CU-5011 | 1140 | GCTAAACCTAGCCCCAAACCC | piRNA-annotate;refseqGeneIntron-annotate |
| CU-5003 | 1141 | ACCCCACTCCTGGTACCA | refseqGeneIntron-annotate |
| CU-5009 | 1142 | TGCCCCATGTCTAACAACATGGCTA | refseqGeneIntron-annotate;rnaGene-annotate |
| CU-5062 | 1143 | CCCCGCCTGTTTACC | refseqGeneIntron-annotate |
| CU-5063 | 1144 | CCCACTTCTGACACCA | computGene-annotate;refseqGeneIntron-annotate;exEID-annotate |
| CU-5064 | 1145 | CACCACCTCTTGCTCAGCC | mRNA-annotate;refseqGeneIntron-annotate |
| CU-5014 | 1146 | CTGGAAAGTGCACTTGGACGAACA | refseqGeneIntron-annotate |
| CU-5065 | 1147 | TGACCGCTCTGACCAC | refseqGeneIntron-annotate |
| CU-5066 | 1148 | TGAAGTCCCTTTGCTTTGTT | refseqGeneIntron-annotate |
| CU-5067 | 1149 | TGAACACACAATAGCTAAGACCC | mRNA-annotate;refseqGeneIntron-annotate |
| CU-5068 | 1150 | TCGCCTTACCCCCCACTA | refseqGeneIntron-annotate |
| CU-5069 | 1151 | TCGATAAACCCCGATCAACCT | mRNA-annotate;refseqGeneIntron-annotate |
| CU-5070 | 1152 | TCCCCGTCACCTCCACCA | refseqGeneIntron-annotate |
| CU-5071 | 1153 | TCCCCGGCACTCCACCA | refseqGeneIntron-annotate |
| CU-5072 | 1154 | TCCCCCCGCTGCCACCA | refseqGeneIntron-annotate |
| CU-5073 | 1155 | TCCCCCCCATCTCCACCA | refseqGeneIntron-annotate |
| CU-5074 | 1156 | TACACACCGCCCGTCACCC | mRNA-annotate;refseqGeneIntron-annotate |
| CU-5076 | 1157 | GCTTAGCCTAGCCACACCCCCACG | mRNA-annotate;refseqGeneIntron-annotate |
| CU-5077 | 1158 | GCTCGCCAGAACACTACGA | mRNA-annotate;refseqGeneIntron-annotate |

TABLE 9-continued (PART A) List of short-RNA lacking genomic locations with appropriate RNA secondary
structures to be defined miRNAs.
Table includes information on genomic locations and annotations.

| ID | SEQ ID NO: | Short-RNA sequence | Annotations |
|---|---|---|---|
| CU-5078 | 1159 | GCCGGGGGCGGGCGCA | refseqGeneIntron-annotate |
| CU-5079 | 1160 | GAACCGGGCGGGAACACCA | refseqGeneIntron-annotate |
| CU-5080 | 1161 | CGCCGCAGTACTGATCATTC | refseqGeneIntron-annotate |
| CU-5081 | 1162 | CCGCACCAATAGGATCCTCC | refseqGeneIntron-annotate |
| CU-5082 | 1163 | CCCGGCCGACGCACCA | refseqGeneIntron-annotate |
| CU-5083 | 1164 | CCACCCCATCATACTCTTTC | refseqGeneIntron-annotate |
| CU-5084 | 1165 | CACCCCCCAGCTCCTCCTTT | refseqGeneIntron-annotate |
| CU-5085 | 1166 | ATAAGTAACATGAAAACATTCTCCTC | refseqGeneIntron-annotate |
| CU-5086 | 1167 | ACTGCTCGCCAGAACAC | mRNA-annotate;refseqGeneIntron-annotate |
| CU-5087 | 1168 | ACCCTGGTGTGGGATCTGCCCGATC | refseqGeneIntron-annotate |
| CU-5088 | 1169 | AACCTCACCACCTCTTTCT | refseqGeneIntron-annotate |
| CU-5089 | 1170 | AAAAGACACCCCCCACACCA | refseqGeneIntron-annotate |
| CU-5021 | 1171 | ACCGGGCGGAAACACCA | tRNAprefix-annotate |
| CU-5022 | 1172 | TCCCGGGTTCAAATCCCGGACGAGCCCCCA | tRNAprefix-annotate |
| CU-5010 | 1173 | GGCCGTGATCGTATA | piRNA-annotate |
| CU-5025 | 1174 | CCCCGTACTGGCCACCA | tRNAprefix-annotate |
| CU-5090 | 1175 | TGGGATGCGAGAGGTCCCGGGT | rnaGene-annotate |
| CU-5031 | 1176 | TCGAATCCTGTTCGTGACGCCA | tRNAprefix-annotate |
| CU-5091 | 1177 | CTGAACTCCTCACACCC | piRNA-annotate |
| CU-5052 | 1178 | ATTCAAAAAAGAGTACCA | tRNAprefix-annotate |
| CU-5092 | 1179 | ATTAATCCCCTGGCCCAACCCG | computGene-annotate |
| CU-5093 | 1180 | AGCCCCAAACCCACTCCAC | piRNA-annotate |
| CU-5094 | 1181 | CGCGACCTCAGATCAGAC | rRNA-eliminate;piRNA-annotate;<br>refseqGeneIntron-annotate |
| CU-5013 | 1182 | GGCCGGTGATGAGAACT | mRNAall-annotate;refseqGeneExon-eliminate;<br>refseqGeneIntron-annotate;wgRNA-annotate;<br>snoRNA-annotate |
| CU-5015 | 1183 | TCAAGTGATGTCATCTTACTACTGAGA | mRNAall-annotate;snoRNA-annotate;<br>refseqGeneExon-eliminate;rnaGene-annotate;<br>refseqGeneIntron-annotate;snoRNA-eliminate;<br>wgRNA-annotate |
| CU-5095 | 1184 | TTGGGTGCGAGAGGTCCCGGGT | tRNAcomputational-annotate;tRNA-eliminate;<br>HStRNA-eliminate;rnaGene-annotate |
| CU-5096 | 1185 | TCTCGGTGGGACCTCCA | tRNAprefix-annotate;refseqGeneExon-eliminate |
| CU-5097 | 1186 | CCGCCCCCCGTTCCCCC | rRNA-eliminate |
| CU-5098 | 1187 | CCCACTGCTAAATTTGACTGGCTT | mRNAall-annotate;yRNA-eliminate;<br>refseqGeneIntron-annotate;rnaGene-annotate |
| CU-5099 | 1188 | ACAGACCAAGAGCCTTC | tRNA-eliminate;rnaGene-annotate |
| CU-5100 | 1189 | TGTAGTAGTCAATTAATGGATATTA | refseqGeneExon-eliminate |
| CU-5101 | 1190 | TGGTTATCACGTTCGCCTCACACGCGA | tRNAcomputational-annotate;tRNA-eliminate;<br>HStRNA-eliminate;rnaGene-annotate |

TABLE 9-continued (PART A) List of short-RNA lacking genomic locations with appropriate RNA secondary structures to be defined miRNAs.
Table includes information on genomic locations and annotations.

| ID | SEQ ID NO: | Short-RNA sequence | Annotations |
|---|---|---|---|
| CU-5102 | 1191 | TGGGAATACCGGGTG | rRNA-eliminate;rnaGene-annotate;piRNA-annotate;refseqGeneIntron-annotate |
| CU-5103 | 1192 | TGGCGGCCAAGCGTTCATAGCGACGTC | rRNA-eliminate;refseqGeneIntron-annotate; rnaGene-annotate |
| CU-5104 | 1193 | TCGTCATCCAGCTAAGGGCTCAGA | mRNAall-annotate;refseqGeneExon-eliminate; exEID-annotate |
| CU-5105 | 1194 | TCGCCTGCCACGCGGGAGGCCCGGGT | rnaGene-annotate;tRNAcomputational-annotate; tRNA-eliminate;refseqGeneIntron-annotate; mRNA-annotate;HStRNA-eliminate |
| CU-5106 | 1195 | TCCCACTGCTTCACTTGA | yRNA-eliminate;refseqGeneIntron-annotate; rnaGene-annotate |
| CU-5107 | 1196 | GTTTAGACGGGCTCACATCACCCCA | tRNA-eliminate;piRNA-annotate; refseqGeneIntron-annotate |
| CU-5075 | 1197 | GGCCGGTGATGAGAACTTCTCCC | mRNAall-annotate;refseqGeneExon-eliminate; refseqGeneIntron-annotate;wgRNA-annotate; snoRNA-annotate |
| CU-5108 | 1198 | GCTAACTCATGCCCCCATGTC | tRNA-eliminate;refseqGeneIntron-annotate; rnaGene-annotate |
| CU-5109 | 1199 | GACTGTGGTGGTTGAATATA | mRNAall-annotate;computGene-annotate; refseqGeneExon-eliminate;exEID-annotate |
| CU-5110 | 1200 | CGCGACCTCAGATCAGACGTGGCGACC | rRNA-eliminate;piRNA-annotate; refseqGeneIntron-annotate |
| CU-5111 | 1201 | CGCCGCCGCCCCCCC | mRNAall-annotate;refseqGeneExon-eliminate; refseqGeneIntron-annotate;exEID-annotate |
| CU-5112 | 1202 | CGCCCGACTACCACCACATCCA | mRNAall-annotate;computGene-annotate; refseqGeneExon-eliminate;exEID-annotate |
| CU-5113 | 1203 | CCCCCCTCCACGCGCCC | rRNA-eliminate;refseqGeneIntron-annotate |
| CU-5114 | 1204 | CCCCACCCCGCGCCCTC | rRNA-eliminate;refseqGeneIntron-annotate |
| CU-5115 | 1205 | CAGAGTGTAGCTTAACACAAAGCACCCAA | tRNA-eliminate;piRNA-annotate;rnaGene-annotate |
| CU-5116 | 1206 | CAATCTTGGCATGTTGGTCTGGTCACCCA | mRNAall-annotate;refseqGeneExon-eliminate; exEID-annotate |
| CU-5117 | 1207 | CAAAGCATCGCGAAGGCCC | mRNAall-annotate;rRNA-eliminate;piRNA-annotate;rnaGene-annotate |
| CU-5118 | 1208 | AACACCCTGATTGCTCCTGTCTGAT | mRNAall-annotate;exEID-annotate;snoRNA-annotate;refseqGeneExon-eliminate;rnaGene-annotate;snoRNA-eliminate;wgRNA-annotate |
| CU-5119 | 1209 | AAAAAGGGCCTAAAGAAGATGCA | mRNAall-annotate;computGene-annotate; refseqGeneExon-eliminate;refseqGeneIntron-annotate;exEID-annotate |

TABLE 9

(PART B) List of short-RNA lacking genomic locations with appropriate RNA secondary structures to be defined miRNAs. Table includes information on counts.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1210 | GAAGCGGGTGCTCTTATTTT | 5 | 23 | 25 | 224 |
| 1211 | GTGTAAGCAGGGTCGTTTT | 0 | 0 | 0 | 7 |
| 1212 | ATCCCACCGCTGCTACCA | 0 | 1 | 0 | 2 |
| 1213 | GGGAAGGTGACCTGAC | 2 | 0 | 0 | 0 |
| 1214 | CTCCCGCCTTTTTTCCC | 0 | 2 | 0 | 0 |
| 1215 | CGGAGCAAGAGCGT | 2 | 0 | 0 | 0 |
| 1216 | CCCCCGGCACCATCAATA | 0 | 0 | 1 | 1 |
| 1217 | CAGCCTAGCCCCTACCC | 0 | 2 | 0 | 0 |
| 1218 | CAGAAGGTCTCACTTTT | 0 | 1 | 0 | 1 |
| 1219 | AGTATTCTCTGTGGCTTT | 0 | 0 | 0 | 2 |
| 1220 | TGGAGTGACTATATGGATGCCCCC | 0 | 0 | 1 | 0 |
| 1221 | TCTGATAGCTTACTTT | 0 | 1 | 0 | 0 |
| 1222 | TCGAGCCCCAGTGGAACCAC | 0 | 0 | 1 | 0 |
| 1223 | TCCTCCCCACACTCATCGCCCTTACCA | 0 | 0 | 1 | 0 |
| 1224 | TATACTACAAGGACACCA | 0 | 0 | 0 | 1 |
| 1225 | TAGTGGGTGAAAAAAAAAAA | 0 | 0 | 0 | 1 |
| 1226 | TACCACACATTCGAAGAACCCGTA | 0 | 0 | 1 | 0 |
| 1227 | TACAAAACCCACCCCATTCCTCCCCA | 0 | 1 | 0 | 0 |
| 1228 | GGAGGGGGGTAAAAAAAA | 0 | 0 | 1 | 0 |
| 1229 | GCCCTCCTAATGACCTCC | 0 | 0 | 1 | 0 |
| 1230 | CTTCCCTCTACACTTATCATC | 0 | 0 | 1 | 0 |
| 1231 | CGGGCGGCCTGCGCTCTCA | 1 | 0 | 0 | 0 |
| 1232 | CCCGAGGCCGTGTGCAAATGCAT | 0 | 0 | 1 | 0 |
| 1233 | CCCCGGCATCTCCACC | 1 | 0 | 0 | 0 |
| 1234 | CCCCCAGTACCTCCACCA | 0 | 1 | 0 | 0 |
| 1235 | CCCCCACTGCTAAACTTGACTGGCTTT | 0 | 0 | 1 | 0 |
| 1236 | CCCACTCCACCTTACTACCA | 0 | 0 | 0 | 1 |
| 1237 | CCCAAGAACAGGGTGACCA | 0 | 0 | 0 | 1 |
| 1238 | CCAGTCGCGGCCAAATCA | 0 | 1 | 0 | 0 |
| 1239 | CCAGCTTCACCAAGGTATTGGTTA | 0 | 0 | 1 | 0 |
| 1240 | CCAGAAAAAACAGGCCTC | 0 | 0 | 0 | 1 |
| 1241 | CATCATAATCGGAGGCTTTGGCAAC | 0 | 0 | 1 | 0 |
| 1242 | CAGCAGGGGTAATAAGTGAAATCAAA | 0 | 0 | 1 | 0 |
| 1243 | CAATGGTGCAGCCGCTATTAAAGGTTCA | 0 | 0 | 0 | 1 |
| 1244 | CAACTCCTACATACTTCCCCC | 1 | 0 | 0 | 0 |
| 1245 | ATGCATCTCATATGCGAATAGGAATGC | 0 | 0 | 1 | 0 |

TABLE 9-continued (PART B) List of short-RNA lacking genomic locations with appropriate RNA secondary structures to be defined miRNAs. Table includes information on counts.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1246 | ATCCCACTTCTGTACCA | 0 | 1 | 0 | 0 |
| 1247 | ATAACACTAGAAAGTTGGGGCAGATTGC | 0 | 0 | 1 | 0 |
| 1248 | ACGTGGGCACATTACCCGTCTGACCTGA | 0 | 0 | 0 | 1 |
| 1249 | ACCCCTTATTAACCCA | 0 | 1 | 0 | 0 |
| 1250 | ACAAGGCACACCTACACCCCTTATCCC | 0 | 0 | 1 | 0 |
| 1251 | AAAAGACACCCCCCCACCA | 0 | 0 | 0 | 1 |
| 1252 | AAAACCCCTACGCATTTATAT | 0 | 0 | 1 | 0 |
| 1253 | AAAAAGACACCCCCCACCA | 0 | 0 | 0 | 1 |
| 1254 | GCTAAACCTAGCCCCAAACCC | 9 | 16 | 13 | 18 |
| 1255 | ACCCCACTCCTGGTACCA | 1 | 11 | 5 | 6 |
| 1256 | TGCCCCCATGTCTAACAACATGGCTA | 7 | 4 | 1 | 1 |
| 1257 | CCCCGCCTGTTTACC | 0 | 5 | 2 | 0 |
| 1258 | CCCACTTCTGACACCA | 3 | 4 | 0 | 0 |
| 1259 | CACCACCTCTTGCTCAGCC | 1 | 3 | 0 | 0 |
| 1260 | CTGGAAAGTGCACTTGGACGAACA | 0 | 2 | 0 | 0 |
| 1261 | TGACCGCTCTGACCAC | 0 | 1 | 0 | 0 |
| 1262 | TGAAGTCCCTTTGCTTTGTT | 1 | 0 | 0 | 0 |
| 1263 | TGAACACACAATAGCTAAGACCC | 0 | 0 | 1 | 0 |
| 1264 | TCGCCTTACCCCCCACTA | 0 | 1 | 0 | 0 |
| 1265 | TCGATAAACCCCGATCAACCT | 0 | 0 | 1 | 0 |
| 1266 | TCCCCGTCACCTCCACCA | 0 | 0 | 1 | 0 |
| 1267 | TCCCCGGCACTCCACCA | 0 | 0 | 1 | 0 |
| 1268 | TCCCCCCGCTGCCACCA | 1 | 0 | 0 | 0 |
| 1269 | TCCCCCCCATCTCCACCA | 0 | 0 | 1 | 0 |
| 1270 | TACACACCGCCCGTCACCC | 0 | 0 | 1 | 0 |
| 1271 | GCTTAGCCTAGCCACACCCCCACG | 0 | 0 | 1 | 0 |
| 1272 | GCTCGCCAGAACACTACGA | 0 | 0 | 1 | 0 |
| 1273 | GCCGGGGGCGGGCGCA | 0 | 1 | 0 | 0 |
| 1274 | GAACCGGGCGGGAACACCA | 0 | 0 | 0 | 1 |
| 1275 | CGCCGCAGTACTGATCATTC | 0 | 0 | 1 | 0 |
| 1276 | CCGCACCAATAGGATCCTCC | 0 | 1 | 0 | 0 |
| 1277 | CCCGGCCGACGCACCA | 1 | 0 | 0 | 0 |
| 1278 | CCACCCCATCATACTCTTTC | 0 | 0 | 1 | 0 |
| 1279 | CACCCCCCAGCTCCTCCTTT | 1 | 0 | 0 | 0 |
| 1280 | ATAAGTAACATGAAAACATTCTCCTC | 0 | 0 | 1 | 0 |

TABLE 9-continued (PART B) List of short-RNA lacking genomic locations with appropriate RNA secondary structures to be defined miRNAs. Table includes information on counts.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1281 | ACTGCTCGCCAGAACAC | 0 | 0 | 1 | 0 |
| 1282 | ACCCTGGTGTGGGATCTGCCCGATC | 0 | 0 | 1 | 0 |
| 1283 | AACCTCACCACCTCTTTCT | 0 | 0 | 1 | 0 |
| 1284 | AAAAGACACCCCCCACACCA | 0 | 0 | 0 | 1 |
| 1285 | ACCGGGCGGAAACACCA | 9 | 14 | 60 | 20 |
| 1286 | TCCCGGGTTCAAATCCCGGACGAGCCCCCA | 0 | 0 | 4 | 37 |
| 1287 | GGCCGTGATCGTATA | 2 | 0 | 0 | 0 |
| 1288 | CCCCGTACTGGCCACCA | 2 | 0 | 0 | 0 |
| 1289 | TGGGATGCGAGAGGTCCCGGGT | 0 | 0 | 0 | 1 |
| 1290 | TCGAATCCTGTTCGTGACGCCA | 0 | 0 | 0 | 1 |
| 1291 | CTGAACTCCTCACACCC | 0 | 1 | 0 | 0 |
| 1292 | ATTCAAAAAAGAGTACCA | 0 | 0 | 1 | 0 |
| 1293 | ATTAATCCCCTGGCCCAACCCG | 0 | 0 | 0 | 1 |
| 1294 | AGCCCCAAACCCACTCCAC | 0 | 0 | 1 | 0 |
| 1295 | CGCGACCTCAGATCAGAC | 1 | 5 | 8 | 1 |
| 1296 | GGCCGGTGATGAGAACT | 4 | 3 | 0 | 0 |
| 1297 | TCAAGTGATGTCATCTTACTACTGAGA | 0 | 0 | 3 | 1 |
| 1298 | TTGGGTGCGAGAGGTCCCGGGT | 0 | 0 | 0 | 3 |
| 1299 | TCTCGGTGGGACCTCCA | 0 | 2 | 0 | 0 |
| 1300 | CCGCCCCCGTTCCCCC | 1 | 1 | 0 | 0 |
| 1301 | CCCACTGCTAAATTTGACTGGCTT | 0 | 0 | 1 | 1 |
| 1302 | ACAGACCAAGAGCCTTC | 0 | 0 | 2 | 0 |
| 1303 | TGTAGTAGTCAATTAATGGATATTA | 0 | 0 | 1 | 0 |
| 1304 | TGGTTATCACGTTCGCCTCACACGCGA | 0 | 0 | 0 | 1 |
| 1305 | TGGGAATACCGGGTG | 0 | 0 | 1 | 0 |
| 1306 | TGGCGGCCAAGCGTTCATAGCGACGTC | 0 | 0 | 0 | 1 |
| 1307 | TCGTCATCCAGCTAAGGGCTCAGA | 0 | 0 | 1 | 0 |
| 1308 | TCGCCTGCCACGCGGGAGGCCCGGGT | 0 | 0 | 1 | 0 |
| 1309 | TCCCACTGCTTCACTTGA | 0 | 0 | 0 | 1 |
| 1310 | GTTTAGACGGGCTCACATCACCCCA | 0 | 0 | 1 | 0 |
| 1311 | GGCCGGTGATGAGAACTTCTCCC | 1 | 0 | 0 | 0 |
| 1312 | GCTAACTCATGCCCCCATGTC | 0 | 0 | 1 | 0 |
| 1313 | GACTGTGGTGGTTGAATATA | 0 | 0 | 0 | 1 |
| 1314 | CGCGACCTCAGATCAGACGTGGCGACC | 0 | 0 | 1 | 0 |
| 1315 | CGCCGCCGCCCCCCC | 0 | 1 | 0 | 0 |

TABLE 9-continued (PART B) List of short-RNA lacking genomic locations with appropriate RNA secondary structures to be defined miRNAs. Table includes information on counts.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1316 | CGCCCGACTACCACCACATCCA | 1 | 0 | 0 | 0 |
| 1317 | CCCCCCTCCACGCGCCC | 0 | 1 | 0 | 0 |
| 1318 | CCCCACCCCGCGCCCTC | 0 | 1 | 0 | 0 |
| 1319 | CAGAGTGTAGCTTAACACAAAGCACCCAA | 0 | 0 | 1 | 0 |
| 1320 | CAATCTTGGCATGTTGGTCTGGTCACCCA | 0 | 0 | 1 | 0 |
| 1321 | CAAAGCATCGCGAAGGCCC | 0 | 0 | 1 | 0 |
| 1322 | AACACCCTGATTGCTCCTGTCTGAT | 0 | 0 | 1 | 0 |
| 1323 | AAAAAGGGCCTAAAGAAGATGCA | 0 | 0 | 1 | 0 |

TABLE 10

(PART A) List of short-RNA consensus with maximum 1 mismatch to the human genome. Table includes information on genomic locations and annotations.

| ID | SEQ ID NO: | Short-RNA sequence | Annotations |
|---|---|---|---|
| CU-6232 | 1324 | TGGCTCAGTTCAGCAGGAACAGT | Mature:hsa-miR-24:MIMAT0000080 |
| CU-6180 | 1325 | GTGGGGGAGAGGCTGTCGA | Mature:hsa-miR-1275:MIMAT0005929 |
| CU-6130 | 1326 | CGGGGCAGCTCAGTACAGGATT | Mature:hsa-miR-486-3p:MIMAT0004762 |
| CU-6044 | 1327 | AATTGCACGGTATCCATCTGTAT | Mature:hsa-miR-363:MIMAT0000707 |
| CU-6239 | 1328 | TGTCAGTTTGTTAATTGACCCAA | NEW |
| CU-6006 | 1329 | GGCAATACGAGCACCCTG | NEW |
| CU-6133 | 1330 | CGGGGGAGCGCCGCGTA | NEW |
| CU-6004 | 1331 | CCGGGGCGTCTCGTAC | NEW |
| CU-6056 | 1332 | AGCGGCTGTGCACAAA | NEW |
| CU-6242 | 1333 | TGTCAGTTTGTTTAATCCAA | NEW |
| CU-6241 | 1334 | TGTCAGTTTGTTATTACCAA | NEW |
| CU-6237 | 1335 | TGTCAGGCACCATCAATAA | NEW |
| CU-6225 | 1336 | TGATCTTGACACTTAAAGCC | NEW |
| CU-6219 | 1337 | TCGTAGGCACCATCAAT | NEW |
| CU-6215 | 1338 | TCGATCCCGGGTTTCGGCACCA | NEW |
| CU-6211 | 1339 | TCGACTCCCGGTATGGGAACCA | NEW |
| CU-6187 | 1340 | TAGGGAGGTTATGATTAACTTTT | NEW |
| CU-6183 | 1341 | TAAAGTGCTTAGTGCAGGTA | NEW |
| CU-6181 | 1342 | GTTTATGTTGCTTACCTCC | NEW |
| CU-6176 | 1343 | GTAGATAAATATTGGCG | NEW |
| CU-6163 | 1344 | GGCGGGACGACGTCAG | NEW |
| CU-6162 | 1345 | GGCGGCGTCGCGGCGGGTC | NEW |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
|---|---|---|---|
| CU-6161 | 1346 | GGAGGGGGTGAACAAAAAGAAAAA | NEW |
| CU-6159 | 1347 | GCTAAACCTAGCCCCAAACCCACTCCACA | NEW |
| CU-6142 | 1348 | CTGGATAGCGCACTTCGTT | NEW |
| CU-6129 | 1349 | CGGGCGAGGGGCGGACGTTCG | NEW |
| CU-6123 | 1350 | CGGACCTATACCGGA | NEW |
| CU-6096 | 1351 | CCCCGGGTTCAATCCCCGGCACCTCCACCA | NEW |
| CU-6088 | 1352 | CCCCCCACAACCGCGAA | NEW |
| CU-6087 | 1353 | CCCAGCATCTCCTGTGTTTA | NEW |
| CU-6086 | 1354 | CCCACGTTGGGACGCCA | NEW |
| CU-6072 | 1355 | ATCGTATCCCACTTCTGACACCA | NEW |
| CU-6064 | 1356 | ATCACGTCCGTGCCTCCA | NEW |
| CU-6063 | 1357 | ATAGCAATGTCAGCAGTACCT | NEW |
| CU-6051 | 1358 | ACCCTGCTCGCTGCGCCA | tRNAprefix-annotate;refseqGeneIntron-annotate |
| CU-6198 | 1359 | TCCCACCCAGGGACGCCA | tRNAprefix-annotate;refseqGeneIntron-annotate |
| CU-6218 | 1360 | TCGTAGGCACATCAATA | refseqGeneIntron-annotate |
| CU-6007 | 1361 | CCCCCACAACCGCGTA | refseqGeneIntron-annotate |
| CU-6001 | 1362 | ACCCCGTCCGTGCCTCCA | tRNAprefix-annotate;refseqGeneIntron-annotate |
| CU-6039 | 1363 | AAAAAAGACACCCCCCACA | refseqGeneIntron-annotate |
| CU-6005 | 1364 | TGTCAGTTTGTTAACCCAA | refseqGeneIntron-annotate |
| CU-6204 | 1365 | TCCCTGTGGTCTAGTGGTTAGG | refseqGeneIntron-annotate |
| CU-6172 | 1366 | GGGGGGGTAAAAAAA | refseqGeneIntron-annotate |
| CU-6171 | 1367 | GGGGGGGGAAAAAAAA | refseqGeneIntron-annotate |
| CU-6128 | 1368 | CGGGCCCGGGTCTTCCC | refseqGeneIntron-annotate |
| CU-6002 | 1369 | CCGCCCCCGTTCCCCCA | refseqGeneIntron-annotate |
| CU-6050 | 1370 | ACCCCCGGCTCCTCCACCA | tRNAprefix-annotate;refseqGeneIntron-annotate |
| CU-6244 | 1371 | TTTGGTGGAAATTTTTGA | refseqGeneIntron-annotate |
| CU-6240 | 1372 | TGTCAGTTTGTTATACCAA | refseqGeneIntron-annotate |
| CU-6238 | 1373 | TGTCAGTTTGTAATTATCCCAA | refseqGeneIntron-annotate |
| CU-6236 | 1374 | TGTCAATTTTTAACCCAA | refseqGeneIntron-annotate |
| CU-6227 | 1375 | TGCTAGGGTAAAAAAAAAA | refseqGeneIntron-annotate |
| CU-6226 | 1376 | TGCAACTCCAAATAAAAGTACCA | tRNAprefix-annotate;refseqGeneIntron-annotate |
| CU-6224 | 1377 | TGAGGTAACGGGGAATTA | refseqGeneIntron-annotate |
| CU-6209 | 1378 | TCCTCGGCATCTCCACCA | refseqGeneIntron-annotate |
| CU-6197 | 1379 | TCATATGAAGTCACCCTAGCCATC | mitochondrion-annotate;refseqGeneIntron-annotate |
| CU-6196 | 1380 | TCAGTTTGTTTATTAACCCAA | refseqGeneIntron-annotate |
| CU-6195 | 1381 | TCAGCGTGTCTTTGCCCT | refseqGeneIntron-annotate |
| CU-6194 | 1382 | TCACTGGTGGTCTAGTGGT | refseqGeneIntron-annotate;rnaGene-annotate |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
|---|---|---|---|
| CU-6193 | 1383 | TCACAATGCTGCCACCA | refseqGeneIntron-annotate |
| CU-6189 | 1384 | TAGTTGTTAATTAACCCAA | refseqGeneIntron-annotate |
| CU-6188 | 1385 | TAGTCCTCATCGCCCTCC | mitochondrion-annotate;refseqGeneIntron-annotate |
| CU-6184 | 1386 | TAAAGTGCTTATAGTGCGGGTAA | refseqGeneIntron-annotate |
| CU-6179 | 1387 | GTCCCACCAGAGTCGCCA | tRNAprefix-annotate;refseqGeneIntron-annotate |
| CU-6170 | 1388 | GGGGGAGGGGCCAAAAAAA | refseqGeneIntron-annotate |
| CU-6167 | 1389 | GGGACGCCGCGGTGTCG | refseqGeneIntron-annotate |
| CU-6166 | 1390 | GGGAATACCGGGTGCTTTAGGCTT | refseqGeneIntron-annotate;rnaGene-annotate |
| CU-6160 | 1391 | GGAAGAAGGTGGTGGTATA | refseqGeneIntron-annotate |
| CU-6156 | 1392 | GCGGTGAAATGCGTA | computGene-annotate;Ecoli-annotate;refseqGeneIntron-annotate |
| CU-6154 | 1393 | GCGGGGAAGGTGGCAAA | refseqGeneIntron-annotate |
| CU-6152 | 1394 | GCGACGACCTCGCGCCCACCTGGTCA | refseqGeneIntron-annotate |
| CU-6151 | 1395 | GCCACCCGATACTGCTGT | refseqGeneIntron-annotate |
| CU-6150 | 1396 | GATGTATGCTTTGTTTCTGTT | refseqGeneIntron-annotate |
| CU-6148 | 1397 | GAGGGGGATTTAGAAAAAAA | refseqGeneIntron-annotate |
| CU-6147 | 1398 | GAAGGAAAGTTCTATAGT | refseqGeneIntron-annotate |
| CU-6146 | 1399 | GAAGCGGCTCTCTTATTT | refseqGeneIntron-annotate |
| CU-6145 | 1400 | GAACGAGACTCTGGCATGCTGA | refseqGeneIntron-annotate;rnaGene-annotate |
| CU-6143 | 1401 | CTGGTAGGCCCATCAAT | refseqGeneIntron-annotate |
| CU-6132 | 1402 | CGGGGCCGATCGCGCGC | computGene-annotate;refseqGeneIntron-annotate |
| CU-6125 | 1403 | CGGCCCCGGGTTCCTCCC | computGene-annotate;refseqGeneIntron-annotate |
| CU-6118 | 1404 | CGAGCCCGGTTAGTA | refseqGeneIntron-annotate;rnaGene-annotate |
| CU-6117 | 1405 | CGACTCTTAGCGGTGGA | piRNA-annotate;refseqGeneIntron-annotate |
| CU-6116 | 1406 | CGAATCCCACTTCTGACACCA | tRNAprefix-annotate;refseqGeneIntron-annotate |
| CU-6113 | 1407 | CGAAAGGGAATCGGGTC | refseqGeneIntron-annotate |
| CU-6112 | 1408 | CCTTAGGTCGCTGGTAAA | refseqGeneIntron-annotate |
| CU-6108 | 1409 | CCGTGCGAGAATACCA | tRNAprefix-annotate;refseqGeneIntron-annotate |
| CU-6107 | 1410 | CCGGTCTCTCAAGCGGCC | refseqGeneIntron-annotate |
| CU-6099 | 1411 | CCCGGCCCTCGCGCGTCC | computGene-annotate;refseqGeneIntron-annotate |
| CU-6094 | 1412 | CCCCGGCATTTCCACCA | computGene-annotate;refseqGeneIntron-annotate |
| CU-6090 | 1413 | CCCCCCCGGCTCCTCCACCA | refseqGeneIntron-annotate |
| CU-6089 | 1414 | CCCCCCACAACCGCTA | refseqGeneIntron-annotate |
| CU-6085 | 1415 | CCCAAGTATTGACTCACCC | mitochondrion-annotate;refseqGeneIntron-annotate |
| CU-6084 | 1416 | CCAGTAAGCGCGAGTC | refseqGeneIntron-annotate |
| CU-6082 | 1417 | CCAAAGAAAGCACGTAGAG | refseqGeneIntron-annotate |

TABLE 10-continued (PART A) List of short-RNA consensus with maximum 1 mismatch to the human genome. Table includes information on genomic locations and annotations.

| ID | SEQ ID NO: | Short-RNA sequence | Annotations |
|---|---|---|---|
| CU-6081 | 1418 | CATGTTTAACGGCCGCGGT | mitochondrion-annotate;refseqGeneIntron-annotate |
| CU-6080 | 1419 | CAGTTTGTAATTAACCCAA | refseqGeneIntron-annotate |
| CU-6079 | 1420 | CAGGAACGGCGCACCA | computGene-annotate;refseqGeneIntron-annotate |
| CU-6078 | 1421 | CAGAACCCTCTAAATCCCC | mitochondrion-annotate;refseqGeneIntron-annotate |
| CU-6076 | 1422 | CACCCGGCTGTGTGCACATGTGT | miRBASE-annotate;computGene-annotate; refseqGeneIntron-annotate;wgRNA-annotate |
| CU-6075 | 1423 | CAATTGGACCAATCTATC | mitochondrion-annotate;refseqGeneIntron-annotate |
| CU-6074 | 1424 | ATTCCTGTACTGCGATA | refseqGeneIntron-annotate |
| CU-6070 | 1425 | ATCCCTGCGGCGTCTCCA | refseqGeneIntron-annotate |
| CU-6067 | 1426 | ATCCCACCGCTGCCATCA | refseqGeneIntron-annotate |
| CU-6062 | 1427 | AGTCAATAGAAGCCGGCGTA | mitochondrion-annotate;refseqGeneIntron-annotate |
| CU-6061 | 1428 | AGGTTCGTTTGTAAAAA | refseqGeneIntron-annotate |
| CU-6060 | 1429 | AGGTCCTGGGTTTAAGTGT | computGene-annotate;refseqGeneIntron-annotate |
| CU-6058 | 1430 | AGGGGGAAGTTCTATAGTC | refseqGeneIntron-annotate |
| CU-6057 | 1431 | AGGCTGTGATGCTCTCNTGAGCCCT | refseqGeneIntron-annotate |
| CU-6055 | 1432 | AGCCCCTCTCCGGCCCTTA | refseqGeneIntron-annotate |
| CU-6054 | 1433 | ACTACCACCTACCTCCC | mitochondrion-annotate;refseqGeneIntron-annotate |
| CU-6052 | 1434 | ACGCCCTTCCCCCCCTTCTTT | miRBASE-annotate;refseqGeneIntron-annotate |
| CU-6049 | 1435 | ACCCCACTCCTGGTGCAC | refseqGeneIntron-annotate |
| CU-6048 | 1436 | ACCACCTGATCCCTTCCC | refseqGeneIntron-annotate |
| CU-6047 | 1437 | ACAGCTAAGCACCCACCA | refseqGeneIntron-annotate |
| CU-6045 | 1438 | ACACATGTTTAACGGCC | mitochondrion-annotate;refseqGeneIntron-annotate |
| CU-6043 | 1439 | AATTAGGGACCTGTATG | refseqGeneIntron-annotate |
| CU-6042 | 1440 | AATGGCCCATTTGGGCAAACA | computGene-annotate;refseqGeneIntron-annotate |
| CU-6041 | 1441 | AAAGCGGCTGTGCAAACA | refseqGeneIntron-annotate |
| CU-6030 | 1442 | ATCCTGCCGACTACGCCA | tRNAprefix-annotate |
| CU-6210 | 1443 | TCGAATCCCACTCCTGACACCA | tRNAprefix-annotate |
| CU-6069 | 1444 | ATCCCATCCTCGTCGCCA | tRNAprefix-annotate |
| CU-6216 | 1445 | TCGATTCCCCGACGGGGAGCCA | tRNAprefix-annotate |
| CU-6071 | 1446 | ATCCGGGTGCCCCCTCCA | tRNAprefix-annotate |
| CU-6212 | 1447 | TCGACTCCTGGCTGGCTCGCCA | tRNAprefix-annotate;wgRNA-annotate |
| CU-6202 | 1448 | TCCCGGGCGGCGCACCA | tRNAprefix-annotate |
| CU-6066 | 1449 | ATCCCACCAGAGTCGCCA | tRNAprefix-annotate |
| CU-6200 | 1450 | TCCCCGGCATCTCCACCAA | computGene-annotate |
| CU-6192 | 1451 | TCAAATCACGTCGGGGTCACCA | tRNAprefix-annotate |
| CU-6157 | 1452 | GCGGTGGATCACTCGGCTCGTGCGT | rnaGene-annotate |
| CU-6214 | 1453 | TCGATCCCCGTACGGGCCACCA | tRNAprefix-annotate |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
|---|---|---|---|
| CU-6213 | 1454 | TCGAGCCTCACCTGGAGCACCA | tRNAprefix-annotate |
| CU-6206 | 1455 | TCCGGCTCGAAGGACCA | tRNAprefix-annotate |
| CU-6105 | 1456 | CCGGGTGTTGTAGA | mRNAall-annotate;exEID-annotate |
| CU-6235 | 1457 | TGTAGCGTGGCCGAGCGGT | rnaGene-annotate |
| CU-6234 | 1458 | TGGGGCGACCTCGGAGCAG | mitochondrion-annotate |
| CU-6230 | 1459 | TGGCGTCCTAAGCCAGGGATTGTGGGT | rnaGene-annotate |
| CU-6229 | 1460 | TGGCAGGGGAGATACCATGATTT | rnaGene-annotate |
| CU-6222 | 1461 | TCTGATCAGGGTGAGCATC | mitochondrion-annotate |
| CU-6220 | 1462 | TCGTAGGCACCATCCAT | computGene-annotate |
| CU-6165 | 1463 | GGGAAACGGGGCGCGGCTG | rnaGene-annotate |
| CU-6137 | 1464 | CTACTCCTGCTCGCATCTGCTATA | mitochondrion-annotate |
| CU-6135 | 1465 | CGGGTGGGTTTTTACCGG | computGene-annotate |
| CU-6120 | 1466 | CGAGGAATTCCCAGTAAG | rnaGene-annotate |
| CU-6115 | 1467 | CGAACGCACTTGCGGCCCC | rnaGene-annotate |
| CU-6093 | 1468 | CCCCGCGCGGGTTCGAATC | rnaGene-annotate |
| CU-6059 | 1469 | AGGGGTATGATTCCCGCTT | rnaGene-annotate |
| CU-6131 | 1470 | CGGGGCCACGCGCGCGTC | mRNA-annotate;rRNA-eliminate |
| CU-6032 | 1471 | TGGCGCTGCGGGATGAAC | rRNA-eliminate;refseqGeneIntron-annotate; rnaGene-annotate |
| CU-1153 | 1472 | CCCCCCACTGCTAAATTTGACTGGCTT | yRNA-eliminate;refseqGeneIntron-annotate; rnaGene-annotate |
| CU-6182 | 1473 | TAAAGGTTCGTTTGTAAAA | computGene-annotate;refseqGeneExon-eliminate |
| CU-6033 | 1474 | CGGGGCCGAGGGAGCGA | rRNA-eliminate;refseqGeneExon-eliminate; refseqGeneIntron-annotate |
| CU-6174 | 1475 | GGGTTAGGCCTCTTTT | tRNA-eliminate;rnaGene-annotate |
| CU-6141 | 1476 | CTGCGGAAGGATCATTA | rRNA-eliminate;rnaGene-annotate |
| CU-6101 | 1477 | CCCTACCCCCCCGG | rRNA-eliminate;refseqGeneIntron-annotate |
| CU-6034 | 1478 | CCCGCCGGGTCCGCCC | computGene-annotate;rRNA-eliminate; refseqGeneExon-eliminate;refseqGeneIntron-annotate;rnaGene-annotate |
| CU-6035 | 1479 | CCCCGCGCCCTCTCTCTC | rRNA-eliminate;refseqGeneIntron-annotate |
| CU-6028 | 1480 | CAGGCCTCCCTGGAATC | computGene-annotate;refseqGeneExon-eliminate; refseqGeneIntron-annotate |
| CU-6029 | 1481 | AGTCCCACCCGGGGTACCA | computGene-annotate;refseqGeneExon-eliminate; tRNAprefix-annotate |
| CU-6243 | 1482 | TTGACACGCCCCAGTGCCCTGT | refseqGeneExon-eliminate |
| CU-6233 | 1483 | TGGGAGCGGGCGGGCGGTC | rRNA-eliminate;rnaGene-annotate |
| CU-6231 | 1484 | TGGCGTGGAGCCGGGCGT | rRNA-eliminate;refseqGeneIntron-annotate |
| CU-6228 | 1485 | TGGAGGTCCGTAGCGGT | rRNA-eliminate;mRNA-annotate; refseqGeneIntron-annotate;rnaGene-annotate |
| CU-6223 | 1486 | TGAAGAAGGTCTCGAACA | computGene-annotate;refseqGeneExon-eliminate |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
|---|---|---|---|
| CU-6221 | 1487 | TCTCGCCGGGGCTTCCA | computGene-annotate;refseqGeneExon-eliminate; rnaGene-annotate |
| CU-6217 | 1488 | TCGTAGCACCATCAATAA | computGene-annotate;refseqGeneExon-eliminate |
| CU-6208 | 1489 | TCCGGGTCCCCCCTCCA | computGene-annotate;refseqGeneExon-eliminate; refseqGeneIntron-annotate |
| CU-6207 | 1490 | TCCGGGGCTGCACGCGCGCT | rRNA-eliminate;rnaGene-annotate |
| CU-6205 | 1491 | TCCGGCCGTGTCGGT | computGene-annotate;refseqGeneExon-eliminate; refseqGeneIntron-annotate |
| CU-6203 | 1492 | TCCCTGTCCTCCAGGAGT | miRBASE-annotate;computGene-annotate; refseqGeneExon-eliminate;refseqGeneIntron-annotate;wgRNA-annotate |
| CU-6201 | 1493 | TCCCCTCCTCGTCGCCA | refseqGeneExon-eliminate;refseqGeneIntron-annotate |
| CU-6199 | 1494 | TCCCAGGTAGTCTAGTGGT | refseqGeneExon-eliminate;refseqGeneIntron-annotate;rnaGene-annotate |
| CU-6191 | 1495 | TATTCATTTATCCCCAGCCTAT | miRBASE-annotate;snoRNA-eliminate; refseqGeneIntron-annotate;wgRNA-annotate; rnaGene-annotate |
| CU-6190 | 1496 | TAGTTGTTATAACCCAA | refseqGeneExon-eliminate;refseqGeneIntron-annotate |
| CU-6186 | 1497 | TAGATCACCCCCTCCCC | mitochondrion-annotate;refseqGeneExon-eliminate;refseqGeneIntron-annotate |
| CU-6185 | 1498 | TACCGGCACCTGGCGCC | computGene-annotate;refseqGeneExon-eliminate; refseqGeneIntron-annotate |
| CU-6178 | 1499 | GTATAGGGGCGAAAGAC | rRNA-eliminate;mRNA-annotate; refseqGeneIntron-annotate;rnaGene-annotate |
| CU-6177 | 1500 | GTAGCTGGTTCCCTCCGAA | rRNA-eliminate;mRNA-annotate; refseqGeneIntron-annotate;rnaGene-annotate |
| CU-6175 | 1501 | GGTAAGAAGCCCGGCTC | computGene-annotate;rRNA-eliminate; refseqGeneExon-eliminate;refseqGeneIntron-annotate;rnaGene-annotate |
| CU-6173 | 1502 | GGGGGGGTTTAAAAAAAA | refseqGeneExon-eliminate;refseqGeneIntron-annotate |
| CU-6169 | 1503 | GGGGCGCACTACCGGCC | refseqGeneExon-eliminate |
| CU-6168 | 1504 | GGGAGAGGCTGTCGCTGCG | computGene-annotate;refseqGeneExon-eliminate |
| CU-6164 | 1505 | GGCGGGTGAAGCGGCG | computGene-annotate;refseqGeneExon-eliminate; refseqGeneIntron-annotate |
| CU-6158 | 1506 | GCGGTTCCGGCGGCGTC | rRNA-eliminate;refseqGeneExon-eliminate; refseqGeneIntron-annotate |
| CU-6155 | 1507 | GCGGGGCGCCTAGGCCTGGTTTGT | refseqGeneExon-eliminate |
| CU-6153 | 1508 | GCGGCGGTCGGCGGGCGGCGGG | rRNA-eliminate;refseqGeneExon-eliminate; refseqGeneIntron-annotate |
| CU-6149 | 1509 | GAGGGGGGGGGTGGGGGGGA | refseqGeneExon-eliminate;refseqGeneIntron-annotate |
| CU-6144 | 1510 | CTGTCGGCCACCATCAT | computGene-annotate;refseqGeneExon-eliminate; refseqGeneIntron-annotate |
| CU-6140 | 1511 | CTGCAACTCGACCCCA | computGene-annotate;refseqGeneExon-eliminate; refseqGeneIntron-annotate |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
|---|---|---|---|
| CU-6139 | 1512 | CTCCTCTCCCCGCCCGCCG | refseqGeneExon-eliminate;refseqGeneIntron-annotate |
| CU-6138 | 1513 | CTCAAAGATTAAGCCATGCATGTCTA | rRNA-eliminate;rnaGene-annotate |
| CU-6136 | 1514 | CTACGCCGCGACGAG | computGene-annotate;rRNA-eliminate |
| CU-6134 | 1515 | CGGGTGACGGGGAATCAGGGTT | rRNA-eliminate;rnaGene-annotate |
| CU-6127 | 1516 | CGGGCAGCTTCCGGGA | computGene-annotate;rRNA-eliminate; refseqGeneExon-eliminate;refseqGeneIntron-annotate |
| CU-6126 | 1517 | CGGGAGGCCCGGGTCCTG | refseqGeneExon-eliminate;refseqGeneIntron-annotate |
| CU-6124 | 1518 | CGGCCCCGCATCCTCCC | computGene-annotate;refseqGeneExon-eliminate; refseqGeneIntron-annotate |
| CU-6122 | 1519 | CGCGGGTAAACGGCGGGAGTAACTAT | mRNAall-annotate;rRNA-eliminate; refseqGeneIntron-annotate;rnaGene-annotate |
| CU-6121 | 1520 | CGCCCCCGTTCCCCCTCC | rRNA-eliminate |
| CU-6119 | 1521 | CGAGCGGAAACACCA | computGene-annotate;refseqGeneExon-eliminate; refseqGeneIntron-annotate;tRNAprefix-annotate |
| CU-6114 | 1522 | CGAACCCGGCACCGC | computGene-annotate;refseqGeneExon-eliminate; refseqGeneIntron-annotate |
| CU-6111 | 1523 | CCTCGGGCCGATCGCAC | rRNA-eliminate;rnaGene-annotate |
| CU-6110 | 1524 | CCTATATATCTTACCA | computGene-annotate;refseqGeneExon-eliminate; refseqGeneIntron-annotate;tRNAprefix-annotate |
| CU-6109 | 1525 | CCGTGGCGGCGACGACC | computGene-annotate;rRNA-eliminate; refseqGeneExon-eliminate |
| CU-6106 | 1526 | CCGGGTTCCGGCACCA | computGene-annotate;refseqGeneExon-eliminate; refseqGeneIntron-annotate |
| CU-6104 | 1527 | CCGCGAGGGGGGCCCG | computGene-annotate;refseqGeneExon-eliminate; refseqGeneIntron-annotate |
| CU-6103 | 1528 | CCGCCTCACGGGACCA | computGene-annotate;refseqGeneExon-eliminate; refseqGeneIntron-annotate |
| CU-6102 | 1529 | CCGCCCGTCCCCGCCCTTG | rRNA-eliminate;refseqGeneIntron-annotate; rnaGene-annotate |
| CU-6100 | 1530 | CCCGGGGCCGCGGTTCCG | computGene-annotate;rRNA-eliminate; refseqGeneIntron-annotate |
| CU-6098 | 1531 | CCCGAGCCGCCTGGAT | computGene-annotate;rRNA-eliminate; refseqGeneExon-eliminate;refseqGeneIntron-annotate;rnaGene-annotate |
| CU-6097 | 1532 | CCCGACGGCCGAACT | computGene-annotate;refseqGeneExon-eliminate; refseqGeneIntron-annotate |
| CU-6095 | 1533 | CCCCGGGGAGCCCGGCGGG | computGene-annotate;refseqGeneExon-eliminate; refseqGeneIntron-annotate |
| CU-6092 | 1534 | CCCCCTCGCGGCCCTCCCC | rRNA-eliminate;refseqGeneIntron-annotate |
| CU-6091 | 1535 | CCCCCCGTGGCGGCGAC | rRNA-eliminate;refseqGeneIntron-annotate |
| CU-6083 | 1536 | CCACCCAGGGCACGCCA | refseqGeneExon-eliminate;refseqGeneIntron-annotate |
| CU-6077 | 1537 | CACGGGTGACGGGGAA | computGene-annotate;rnaGene-annotate; refseqGeneIntron-annotate;rRNA-eliminate; refseqGeneExon-eliminate;piRNA-annotate |

TABLE 10-continued (PART A) List of short-RNA consensus with maximum 1 mismatch to the human genome.
Table includes information on genomic locations and annotations.

| ID | SEQ ID NO: | Short-RNA sequence | Annotations |
| --- | --- | --- | --- |
| CU-6073 | 1538 | ATGGGGAGGAAAAAAAAAAAAA | refseqGeneExon-eliminate;refseqGeneIntron-annotate |
| CU-6068 | 1539 | ATCCCACCGCTGCCCCCA | computGene-annotate;refseqGeneExon-eliminate; refseqGeneIntron-annotate |
| CU-6065 | 1540 | ATCACGTCGGTCACCA | computGene-annotate;refseqGeneExon-eliminate; refseqGeneIntron-annotate |
| CU-6053 | 1541 | ACGGGAAACCTCACCCGGCCCGG | rRNA-eliminate;piRNA-annotate;rnaGene-annotate |
| CU-6046 | 1542 | ACAGAGGCTTACGACCCCTTATTT | mitochondrion-annotate;tRNA-eliminate; refseqGeneIntron-annotate;rnaGene-annotate |
| CU-6040 | 1543 | AAAAAGGCATAATTAAACTT | mitochondrion-annotate;refseqGeneExon-eliminate;refseqGeneIntron-annotatep |

TABLE 10

(PART B) List of short-RNA consensus with maximum 1 mismatch
to the human genome, including count information.

| | | Corrected Counts | | | |
| --- | --- | --- | --- | --- | --- |
| SEQ ID NO: | Short-RNA sequence | Naive (N) | Memory (M) | Centroblasts (CB) | Ramos (RA) |
| 1544 | TGGCTCAGTTCAGCAGGAACAGT | 0 | 0 | 1 | 0 |
| 1545 | GTGGGGGAGAGGCTGTCGA | 0 | 0 | 0 | 1 |
| 1546 | CGGGGCAGCTCAGTACAGGATT | 0 | 0 | 1 | 0 |
| 1547 | AATTGCACGGTATCCATCTGTAT | 0 | 0 | 1 | 0 |
| 1548 | TGTCAGTTTGTTAATTGACCCAA | 0 | 0 | 1 | 1 |
| 1549 | GGCAATACGAGCACCCTG | 2 | 0 | 0 | 0 |
| 1550 | CGGGGGAGCGCCGCGTA | 2 | 0 | 0 | 0 |
| 1551 | CCGGGGCGTCTCGTAC | 2 | 0 | 0 | 0 |
| 1552 | AGCGGCTGTGCACAAA | 0 | 0 | 0 | 2 |
| 1553 | TGTCAGTTTGTTTAATCCAA | 0 | 0 | 0 | 1 |
| 1554 | TGTCAGTTTGTTATTACCAA | 0 | 0 | 0 | 1 |
| 1555 | TGTCAGGCACCATCAATAA | 0 | 0 | 0 | 1 |
| 1556 | TGATCTTGACACTTAAAGCC | 0 | 0 | 0 | 1 |
| 1557 | TCGTAGGCACCATCAAT | 0 | 0 | 0 | 1 |
| 1558 | TCGATCCCGGGTTTCGGCACCA | 0 | 0 | 1 | 0 |
| 1559 | TCGACTCCCGGTATGGGAACCA | 0 | 0 | 0 | 1 |
| 1560 | TAGGGAGGTTATGATTAACTTTT | 0 | 0 | 0 | 1 |
| 1561 | TAAAGTGCTTAGTGCAGGTA | 0 | 0 | 0 | 1 |
| 1562 | GTTTATGTTGCTTACCTCC | 0 | 0 | 1 | 0 |
| 1563 | GTAGATAAATATTGGCG | 1 | 0 | 0 | 0 |
| 1564 | GGCGGGGACGACGTCAG | 0 | 0 | 0 | 1 |
| 1565 | GGCGGCGTCGCGGCGGGTC | 0 | 1 | 0 | 0 |

TABLE 10-continued (PART B) List of short-RNA consensus with maximum 1 mismatch to the human genome, including count information.

| SEQ ID NO: | Short-RNA sequence | Corrected Counts | | | |
| --- | --- | --- | --- | --- | --- |
| | | Naïve (N) | Memory (M) | Centroblasts (CB) | Ramos (RA) |
| 1566 | GGAGGGGGTGAACAAAAAGAAAAA | 0 | 0 | 0 | 1 |
| 1567 | GCTAAACCTAGCCCCAAACCCACTCCACA | 0 | 0 | 0 | 1 |
| 1568 | CTGGATAGCGCACTTCGTT | 0 | 0 | 0 | 1 |
| 1569 | CGGGCGAGGGGCGGACGTTCG | 0 | 0 | 1 | 0 |
| 1570 | CGGACCTATACCGGA | 1 | 0 | 0 | 0 |
| 1571 | CCCCGGGTTCAATCCCCGGCACCTCCACCA | 0 | 0 | 1 | 0 |
| 1572 | CCCCCCACAACCGCGAA | 0 | 1 | 0 | 0 |
| 1573 | CCCAGCATCTCCTGTGTTTA | 0 | 1 | 0 | 0 |
| 1574 | CCCACGTTGGGACGCCA | 1 | 0 | 0 | 0 |
| 1575 | ATCGTATCCCACTTCTGACACCA | 0 | 0 | 0 | 1 |
| 1576 | ATCACGTCCGTGCCTCCA | 0 | 1 | 0 | 0 |
| 1577 | ATAGCAATGTCAGCAGTACCT | 0 | 0 | 1 | 0 |
| 1578 | ACCCTGCTCGCTGCGCCA | 9 | 17 | 4 | 7 |
| 1579 | TCCCACCCAGGGACGCCA | 8 | 2 | 1 | 0 |
| 1580 | TCGTAGGCACATCAATA | 0 | 0 | 0 | 4 |
| 1581 | CCCCCACAACCGCGTA | 0 | 4 | 0 | 0 |
| 1582 | ACCCCGTCCGTGCCTCCA | 2 | 1 | 1 | 0 |
| 1583 | AAAAAAGACACCCCCCACA | 0 | 0 | 0 | 3 |
| 1584 | TGTCAGTTTGTTAACCCAA | 0 | 0 | 0 | 2 |
| 1585 | TCCCTGTGGTCTAGTGGTTAGG | 0 | 0 | 1 | 1 |
| 1586 | GGGGGGGTAAAAAAA | 0 | 0 | 0 | 1 |
| 1587 | GGGGGGGGAAAAAAAA | 0 | 0 | 0 | 1 |
| 1588 | CGGGCCCGGGTCTTCCC | 1 | 1 | 0 | 0 |
| 1589 | CCGCCCCCGTTCCCCCA | 0 | 2 | 0 | 0 |
| 1590 | ACCCCCGGCTCCTCCACCA | 0 | 1 | 0 | 1 |
| 1591 | TTTGGTGGAAATTTTTTGA | 0 | 0 | 0 | 1 |
| 1592 | TGTCAGTTTGTTATACCAA | 0 | 0 | 0 | 1 |
| 1593 | TGTCAGTTTGTAATTATCCCAA | 0 | 0 | 0 | 1 |
| 1594 | TGTCAATTTTTAACCCAA | 0 | 0 | 0 | 1 |
| 1595 | TGCTAGGGTAAAAAAAAAA | 0 | 0 | 0 | 1 |
| 1596 | TGCAACTCCAAATAAAGTACCA | 0 | 0 | 0 | 1 |
| 1597 | TGAGGTAACGGGGAATTA | 0 | 0 | 0 | 1 |
| 1598 | TCCTCGGCATCTCCACCA | 0 | 0 | 1 | 0 |
| 1599 | TCATATGAAGTCACCCTAGCCATC | 0 | 0 | 1 | 0 |
| 1600 | TCAGTTTGTTTATTAACCCAA | 0 | 0 | 0 | 1 |

TABLE 10-continued (PART B) List of short-RNA consensus with maximum 1 mismatch to the human genome, including count information.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1601 | TCAGCGTGTCTTTGCCCT | 1 | 0 | 0 | 0 |
| 1602 | TCACTGGTGGTCTAGTGGT | 0 | 1 | 0 | 0 |
| 1603 | TCACAATGCTGCCACCA | 1 | 0 | 0 | 0 |
| 1604 | TAGTTGTTAATTAACCCAA | 0 | 0 | 0 | 1 |
| 1605 | TAGTCCTCATCGCCCTCC | 0 | 1 | 0 | 0 |
| 1606 | TAAAGTGCTTATAGTGCGGGTAA | 0 | 0 | 0 | 1 |
| 1607 | GTCCCACCAGAGTCGCCA | 0 | 0 | 1 | 0 |
| 1608 | GGGGGAGGGGCCAAAAAAA | 0 | 0 | 0 | 1 |
| 1609 | GGGACGCCGCGGTGTCG | 1 | 0 | 0 | 0 |
| 1610 | GGGAATACCGGGTGCTTTAGGCTT | 0 | 1 | 0 | 0 |
| 1611 | GGAAGAAGGTGGTGGTATA | 0 | 0 | 0 | 1 |
| 1612 | GCGGTGAAATGCGTA | 1 | 0 | 0 | 0 |
| 1613 | GCGGGGAAGGTGGCAAA | 0 | 0 | 0 | 1 |
| 1614 | GCGACGACCTCGCGCCCACCTGGTCA | 0 | 1 | 0 | 0 |
| 1615 | GCCACCCGATACTGCTGT | 0 | 1 | 0 | 0 |
| 1616 | GATGTATGCTTTGTTTCTGTT | 0 | 0 | 1 | 0 |
| 1617 | GAGGGGGATTTAGAAAAAAA | 0 | 0 | 0 | 1 |
| 1618 | GAAGGAAAGTTCTATAGT | 0 | 0 | 0 | 1 |
| 1619 | GAAGCGGCTCTCTTATTT | 0 | 0 | 0 | 1 |
| 1620 | GAACGAGACTCTGGCATGCTGA | 0 | 0 | 1 | 0 |
| 1621 | CTGGTAGGCCCATCAAT | 0 | 0 | 0 | 1 |
| 1622 | CGGGGCCGATCGCGCGC | 0 | 1 | 0 | 0 |
| 1623 | CGGCCCCGGGTTCCTCCC | 1 | 0 | 0 | 0 |
| 1624 | CGAGCCCGGTTAGTA | 1 | 0 | 0 | 0 |
| 1625 | CGACTCTTAGCGGTGGA | 0 | 0 | 1 | 0 |
| 1626 | CGAATCCCACTTCTGACACCA | 0 | 0 | 0 | 1 |
| 1627 | CGAAAGGGAATCGGGTC | 1 | 0 | 0 | 0 |
| 1628 | CCTTAGGTCGCTGGTAAA | 0 | 0 | 1 | 0 |
| 1629 | CCGTGCGAGAATACCA | 0 | 1 | 0 | 0 |
| 1630 | CCGGTCTCTCAAGCGGCC | 1 | 0 | 0 | 0 |
| 1631 | CCCGGCCCTCGCGCGTCC | 0 | 1 | 0 | 0 |
| 1632 | CCCCGGCATTTCCACCA | 0 | 0 | 1 | 0 |
| 1633 | CCCCCCCGGCTCCTCCACCA | 0 | 0 | 0 | 1 |
| 1634 | CCCCCCACAACCGCTA | 0 | 1 | 0 | 0 |
| 1635 | CCCAAGTATTGACTCACCC | 0 | 1 | 0 | 0 |
| 1636 | CCAGTAAGCGCGAGTC | 1 | 0 | 0 | 0 |

TABLE 10-continued (PART B) List of short-RNA consensus with maximum 1 mismatch to the human genome, including count information.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1637 | CCAAAGAAAGCACGTAGAG | 0 | 0 | 0 | 1 |
| 1638 | CATGTTTAACGGCCGCGGT | 0 | 0 | 1 | 0 |
| 1639 | CAGTTTGTAATTAACCCAA | 0 | 0 | 0 | 1 |
| 1640 | CAGGAACGGCGCACCA | 0 | 0 | 1 | 0 |
| 1641 | CAGAACCCTCTAAATCCCC | 0 | 0 | 1 | 0 |
| 1642 | CACCCGGCTGTGTGCACATGTGT | 1 | 0 | 0 | 0 |
| 1643 | CAATTGGACCAATCTATC | 0 | 0 | 1 | 0 |
| 1644 | ATTCCTGTACTGCGATA | 0 | 0 | 0 | 1 |
| 1645 | ATCCCTGCGGCGTCTCCA | 0 | 0 | 0 | 1 |
| 1646 | ATCCCACCGCTGCCATCA | 0 | 1 | 0 | 0 |
| 1647 | AGTCAATAGAAGCCGGCGTA | 0 | 0 | 1 | 0 |
| 1648 | AGGTTCGTTTGTAAAAA | 0 | 0 | 0 | 1 |
| 1649 | AGGTCCTGGGTTTAAGTGT | 0 | 0 | 0 | 1 |
| 1650 | AGGGGGAAGTTCTATAGTC | 0 | 0 | 0 | 1 |
| 1651 | AGGCTGTGATGCTCTCNTGAGCCCT | 0 | 0 | 1 | 0 |
| 1652 | AGCCCTCTCCGGCCCTTA | 0 | 1 | 0 | 0 |
| 1653 | ACTACCACCTACCTCCC | 1 | 0 | 0 | 0 |
| 1654 | ACGCCCTTCCCCCCCTTCTTT | 0 | 0 | 0 | 1 |
| 1655 | ACCCCACTCCTGGTGCAC | 1 | 0 | 0 | 0 |
| 1656 | ACCACCTGATCCCTTCCC | 1 | 0 | 0 | 0 |
| 1657 | ACAGCTAAGCACCCACCA | 0 | 0 | 1 | 0 |
| 1658 | ACACATGTTTAACGGCC | 1 | 0 | 0 | 0 |
| 1659 | AATTAGGGACCTGTATG | 0 | 0 | 1 | 0 |
| 1660 | AATGCCCATTTGGGCAAACA | 0 | 0 | 0 | 1 |
| 1661 | AAAGCGGCTGTGCAAACA | 0 | 0 | 0 | 1 |
| 1662 | ATCCTGCCGACTACGCCA | 13 | 15 | 13 | 6 |
| 1663 | TCGAATCCCACTCCTGACACCA | 1 | 2 | 7 | 7 |
| 1664 | ATCCCATCCTCGTCGCCA | 0 | 0 | 10 | 3 |
| 1665 | TCGATTCCCCGACGGGGAGCCA | 1 | 1 | 1 | 9 |
| 1666 | ATCCGGGTGCCCCCTCCA | 2 | 4 | 0 | 1 |
| 1667 | TCGACTCCTGGCTGGCTCGCCA | 0 | 2 | 2 | 1 |
| 1668 | TCCCGGGCGGCGCACCA | 2 | 2 | 1 | 0 |
| 1669 | ATCCCACCAGAGTCGCCA | 0 | 0 | 2 | 3 |
| 1670 | TCCCCGGCATCTCCACCAA | 0 | 1 | 2 | 0 |
| 1671 | TCAAATCACGTCGGGGTCACCA | 0 | 1 | 2 | 0 |
| 1672 | GCGGTGGATCACTCGGCTCGTGCGT | 0 | 0 | 0 | 3 |

TABLE 10-continued (PART B) List of short-RNA consensus with maximum 1 mismatch to the human genome, including count information.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1673 | TCGATCCCCGTACGGGCCACCA | 0 | 0 | 1 | 1 |
| 1674 | TCGAGCCTCACCTGGAGCACCA | 0 | 0 | 2 | 0 |
| 1675 | TCCGGCTCGAAGGACCA | 0 | 0 | 2 | 0 |
| 1676 | CCGGGTGTTGTAGA | 2 | 0 | 0 | 0 |
| 1677 | TGTAGCGTGGCCGAGCGGT | 0 | 1 | 0 | 0 |
| 1678 | TGGGGCGACCTCGGAGCAG | 0 | 0 | 1 | 0 |
| 1679 | TGGCGTCCTAAGCCAGGGATTGTGGGT | 0 | 0 | 0 | 1 |
| 1680 | TGGCAGGGGAGATACCATGATTT | 0 | 0 | 1 | 0 |
| 1681 | TCTGATCAGGGTGAGCATC | 0 | 1 | 0 | 0 |
| 1682 | TCGTAGGCACCATCCAT | 0 | 0 | 0 | 1 |
| 1683 | GGGAAACGGGGCGCGGCTG | 0 | 1 | 0 | 0 |
| 1684 | CTACTCCTGCTCGCATCTGCTATA | 0 | 0 | 1 | 0 |
| 1685 | CGGGTGGGTTTTTACCGG | 1 | 0 | 0 | 0 |
| 1686 | CGAGGAATTCCCAGTAAG | 0 | 0 | 1 | 0 |
| 1687 | CGAACGCACTTGCGGCCCC | 1 | 0 | 0 | 0 |
| 1688 | CCCCGCGCGGGTTCGAATC | 1 | 0 | 0 | 0 |
| 1689 | AGGGGTATGATTCCCGCTT | 0 | 0 | 0 | 1 |
| 1690 | CGGGGCCACGCGCGCGTC | 3 | 6 | 0 | 0 |
| 1691 | TGGCGCTGCGGGATGAAC | 0 | 3 | 1 | 0 |
| 1692 | CCCCCCACTGCTAAATTTGACTGGCTT | 0 | 0 | 2 | 2 |
| 1693 | TAAAGGTTCGTTTGTAAAA | 0 | 0 | 0 | 3 |
| 1694 | CGGGGCCGAGGGAGCGA | 1 | 2 | 0 | 0 |
| 1695 | GGGTTAGGCCTCTTTT | 0 | 1 | 1 | 0 |
| 1696 | CTGCGGAAGGATCATTA | 1 | 0 | 1 | 0 |
| 1697 | CCCTACCCCCCCGG | 0 | 2 | 0 | 0 |
| 1698 | CCCGCCGGGTCCGCCC | 2 | 0 | 0 | 0 |
| 1699 | CCCCGCGCCCTTCTCTCTC | 0 | 2 | 0 | 0 |
| 1700 | CAGGCCTCCCTGGAATC | 2 | 0 | 0 | 0 |
| 1701 | AGTCCCACCCGGGGTACCA | 0 | 0 | 0 | 2 |
| 1702 | TTGACACGCCCCAGTGCCCTGT | 1 | 0 | 0 | 0 |
| 1703 | TGGGAGCGGGCGGGCGGTC | 0 | 1 | 0 | 0 |
| 1704 | TGGCGTGGAGCCGGGCGT | 0 | 1 | 0 | 0 |
| 1705 | TGGAGGTCCGTAGCGGT | 1 | 0 | 0 | 0 |
| 1706 | TGAAGAAGGTCTCGAACA | 0 | 0 | 0 | 1 |
| 1707 | TCTCGCCGGGGCTTCCA | 0 | 1 | 0 | 0 |
| 1708 | TCGTAGCACCATCAATAA | 0 | 0 | 0 | 1 |

TABLE 10-continued (PART B) List of short-RNA consensus with maximum 1 mismatch to the human genome, including count information.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1709 | TCCGGGTCCCCCCTCCA | 0 | 1 | 0 | 0 |
| 1710 | TCCGGGGCTGCACGCGCGCT | 0 | 1 | 0 | 0 |
| 1711 | TCCGGCCGTGTCGGT | 1 | 0 | 0 | 0 |
| 1712 | TCCCTGTCCTCCAGGAGT | 0 | 0 | 0 | 1 |
| 1713 | TCCCCTCCTCGTCGCCA | 1 | 0 | 0 | 0 |
| 1714 | TCCCAGGTAGTCTAGTGGT | 1 | 0 | 0 | 0 |
| 1715 | TATTCATTTATCCCCAGCCTAT | 0 | 1 | 0 | 0 |
| 1716 | TAGTTGTTATAACCCAA | 0 | 0 | 0 | 1 |
| 1717 | TAGATCACCCCCTCCCC | 0 | 1 | 0 | 0 |
| 1718 | TACCGGCACCTGGCGCC | 1 | 0 | 0 | 0 |
| 1719 | GTATAGGGGCGAAAGAC | 0 | 0 | 1 | 0 |
| 1720 | GTAGCTGGTTCCCTCCGAA | 0 | 0 | 0 | 1 |
| 1721 | GGTAAGAAGCCCGGCTC | 0 | 0 | 1 | 0 |
| 1722 | GGGGGGGTTTAAAAAAAAA | 0 | 0 | 0 | 1 |
| 1723 | GGGGCGCACTACCGGCC | 1 | 0 | 0 | 0 |
| 1724 | GGGAGAGGCTGTCGCTGCG | 0 | 0 | 0 | 1 |
| 1725 | GGCGGGTGAAGCGGCG | 0 | 1 | 0 | 0 |
| 1726 | GCGGTTCCGGCGGCGTC | 0 | 1 | 0 | 0 |
| 1727 | GCGGGGCGCCTAGGCCTGGTTTGT | 1 | 0 | 0 | 0 |
| 1728 | GCGGCGGTCGGCGGGCGGCGGG | 1 | 0 | 0 | 0 |
| 1729 | GAGGGGGGGGGTGGGGGGGA | 0 | 0 | 0 | 1 |
| 1730 | CTGTCGGCCACCATCAT | 0 | 0 | 0 | 1 |
| 1731 | CTGCAACTCGACCCCA | 0 | 1 | 0 | 0 |
| 1732 | CTCCTCTCCCCGCCCGCCG | 0 | 0 | 1 | 0 |
| 1733 | CTCAAAGATTAAGCCATGCATGTCTA | 0 | 0 | 1 | 0 |
| 1734 | CTACGCCGCGACGAG | 1 | 0 | 0 | 0 |
| 1735 | CGGGTGACGGGGAATCAGGGTT | 1 | 0 | 0 | 0 |
| 1736 | CGGGCAGCTTCCGGGA | 0 | 0 | 0 | 1 |
| 1737 | CGGGAGGCCCGGGTCCTG | 1 | 0 | 0 | 0 |
| 1738 | CGGCCCCGCATCCTCCC | 1 | 0 | 0 | 0 |
| 1739 | CGCGGGTAAACGGCGGGAGTAACTAT | 0 | 0 | 1 | 0 |
| 1740 | CGCCCCCCGTTCCCCCCTCC | 0 | 1 | 0 | 0 |
| 1741 | CGAGCGGAAACACCA | 1 | 0 | 0 | 0 |
| 1742 | CGAACCCGGCACCGC | 1 | 0 | 0 | 0 |
| 1743 | CCTCGGGCCGATCGCAC | 0 | 0 | 1 | 0 |
| 1744 | CCTATATATCTTACCA | 0 | 1 | 0 | 0 |

TABLE 10-continued (PART B) List of short-RNA consensus with maximum 1 mismatch to the human genome, including count information.

| SEQ ID NO: | Short-RNA sequence | Corrected Counts | | | |
|---|---|---|---|---|---|
| | | Naïve (N) | Memory (M) | Centroblasts (CB) | Ramos (RA) |
| 1745 | CCGTGGCGGCGACGACC | 0 | 1 | 0 | 0 |
| 1746 | CCGGGTTCCGGCACCA | 1 | 0 | 0 | 0 |
| 1747 | CCGCGAGGGGGGCCCG | 1 | 0 | 0 | 0 |
| 1748 | CCGCCTCACGGGACCA | 1 | 0 | 0 | 0 |
| 1749 | CCGCCCGTCCCCGCCCCTTG | 0 | 1 | 0 | 0 |
| 1750 | CCCGGGGCCGCGGTTCCG | 1 | 0 | 0 | 0 |
| 1751 | CCCGAGCCGCCTGGAT | 0 | 1 | 0 | 0 |
| 1752 | CCCGACGGCCGAACT | 0 | 1 | 0 | 0 |
| 1753 | CCCCGGGGAGCCCGGCGGG | 1 | 0 | 0 | 0 |
| 1754 | CCCCCTCGCGGCCCTCCCC | 0 | 1 | 0 | 0 |
| 1755 | CCCCCCGTGGCGGCGAC | 0 | 1 | 0 | 0 |
| 1756 | CCACCCAGGGCACGCCA | 1 | 0 | 0 | 0 |
| 1757 | CACGGGTGACGGGGAA | 1 | 0 | 0 | 0 |
| 1758 | ATGGGGAGGAAAAAAAAAAAAA | 0 | 0 | 0 | 1 |
| 1759 | ATCCCACCGCTGCCCCCA | 0 | 0 | 0 | 1 |
| 1760 | ATCACGTCGGTCACCA | 0 | 0 | 0 | 1 |
| 1761 | ACGGGAAACCTCACCCGGCCCGG | 0 | 0 | 1 | 0 |
| 1762 | ACAGAGGCTTACGACCCCTTATTT | 0 | 0 | 1 | 0 |
| 1763 | AAAAAGGCATAATTAAACTT | 0 | 0 | 1 | 0 |

Abundance and Evolutionary Conservation.

Figure 20A:
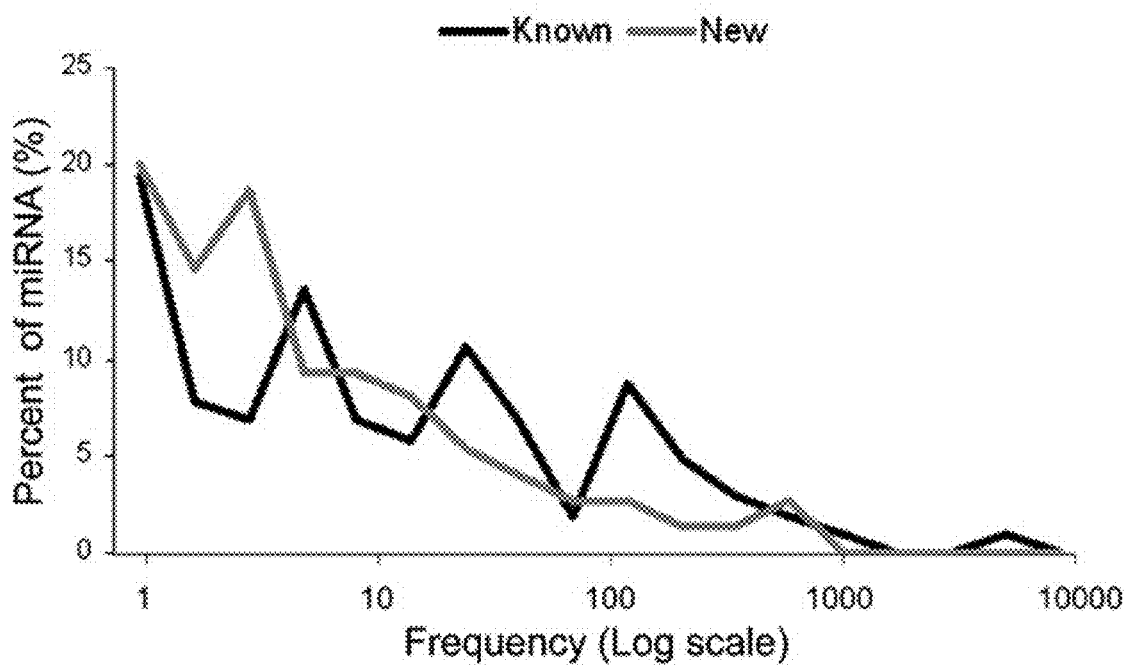
FIG. 20A is a graph of the frequencies of previously reported (known) and to our knowledge newly identified (new) miRNAs as occurring in centroblasts, memory and Ramos cells.
Figure 20B:
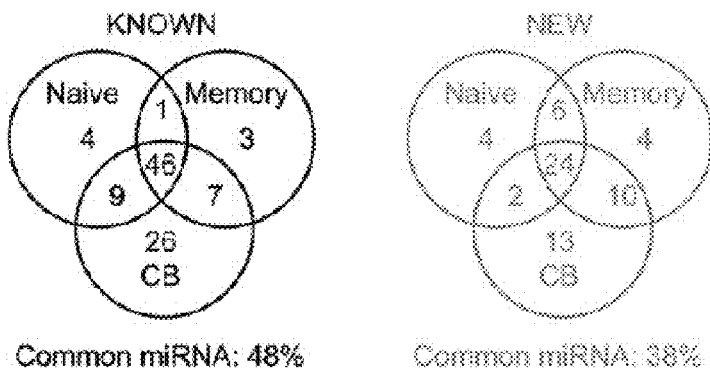
FIG. 20B are Venn diagrams showing the number of miRNAs cloned multiple times and identified in naïve, centroblasts and memory B cells. A larger overlap is observed for known compared to new miRNA (48% versus 38%).

Previously reported miRNAs appeared to be generally more abundant than newly discovered miRNAs. Approximately 50% of previously reported miRNAs appeared in the libraries with more than 10 occurrences compared to 29% of the newly discovered miRNAs (FIG. 20A). Moreover, 48% of known miRNAs were expressed at all stages of mature B-cell development, while newly identified miRNAs showed a more distinct stage-specificity (FIG. 20B), consistent with the notion that presently known miRNAs are mostly representative of ubiquitously expressed miRNAs.

Figure 20C:
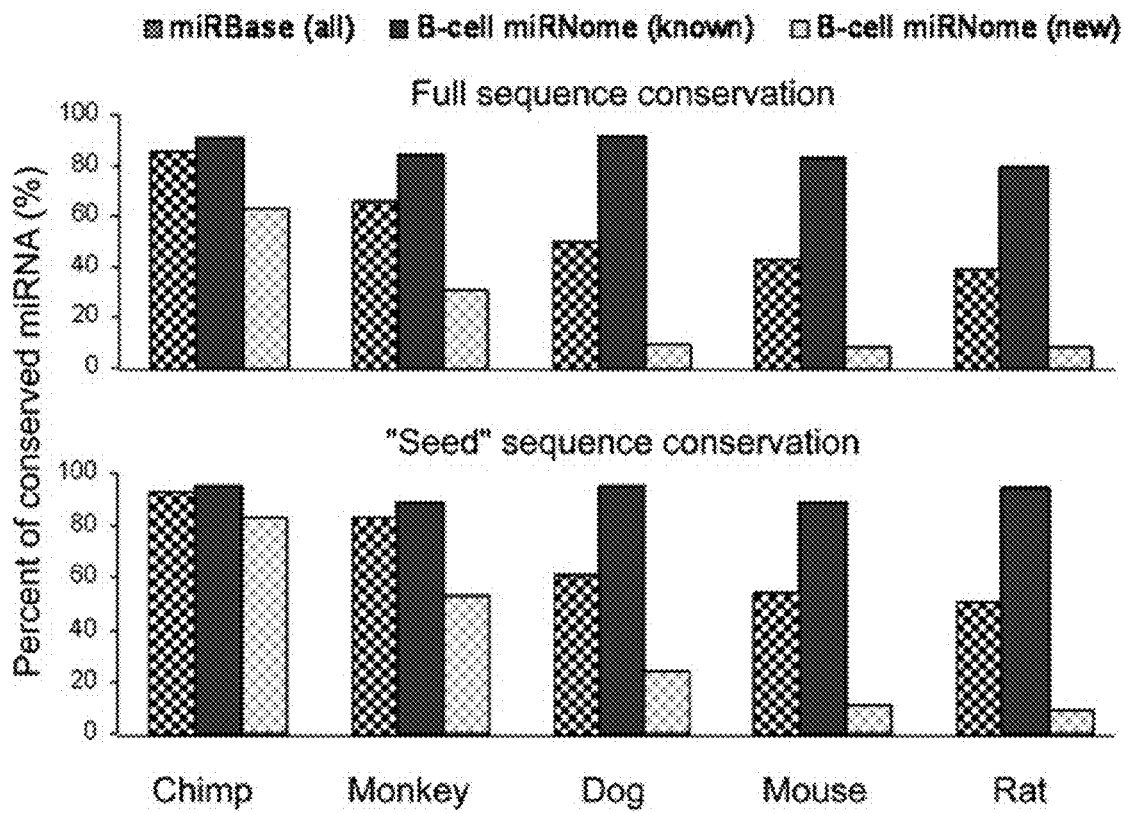
FIG. 20C are bar graphs that show the conservation analysis for orthologous miRNAs that was performed in 5 mammal species for all miRNA reported in the miRBase database (miRBase-all) and for known and new mature miRNA expressed in the B-cell libraries. The percentages of miRNAs having either perfect conservation for the entire mature miRNA (top panel) or for its seeds (bottom panel) are displayed.

In order to investigate the presence of orthologous miRNA in other mammalian species, we relied on UCSC-provided Blastz pairwise alignments between human and target species and investigated conservation using two complementary methods, detailed in Supplemental Experimental Procedures. The analysis was performed on the complete set of miRNAs deposited in the miRBase database and on the miRNAs (known and new) represented in the B-cell libraries. Alignments of the human mature miRNA to its target species were required to have either perfect conservation of the entire mature miRNA sequence or conservation of seeds composed of seven bases starting from the second position of the human mature sequence followed by conservation of 3 bases starting from the 12th, 13th or 14th position as suggested by (Grimson et al., 2007) (FIG. 20C and Appendix Table 11).

The majority of miRBase-miRNAs showed conservation across mammalian genomes, from primates to rodents. Conservation frequency mimicked known phylogenetic distances to human, with the highest conservation in chimp and lowest in rat. The conservation frequencies of known and newly identified miRNAs in B cells were similar in chimp (*Pan troglodytes*) and monkey (*Macacus rhesus*), especially when conservation requirements were restricted to the seed region of miRNAs. However, conservation frequencies in dog, mouse and rat were significantly divergent, with known miRNAs more likely to exhibit conservation than new candidate miRNAs (FIG. 20C and Appendix Table 11). In summary, previously unreported miRNAs expressed at specific stages of B-cell differentiation were generally less abundant and showed a lower degree of conservation across species, as shown for other tissue-specific miRNAs.

Validation of Previously Unreported miRNAs.

Figure 21A:
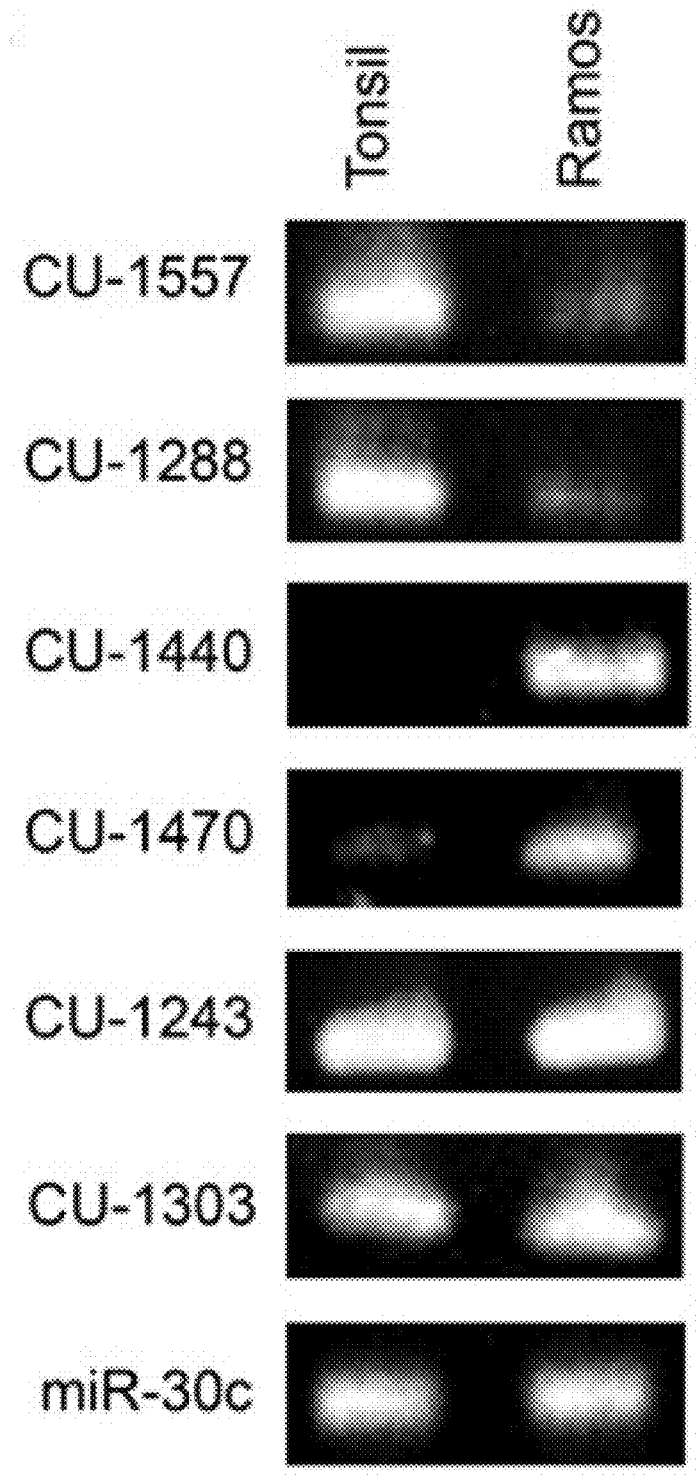
FIG. 21A shows representative results of RT-PCR detection of miRNA in Ramos cell line and tonsil cells. miR-30c was used as loading control.
Figure 21B:
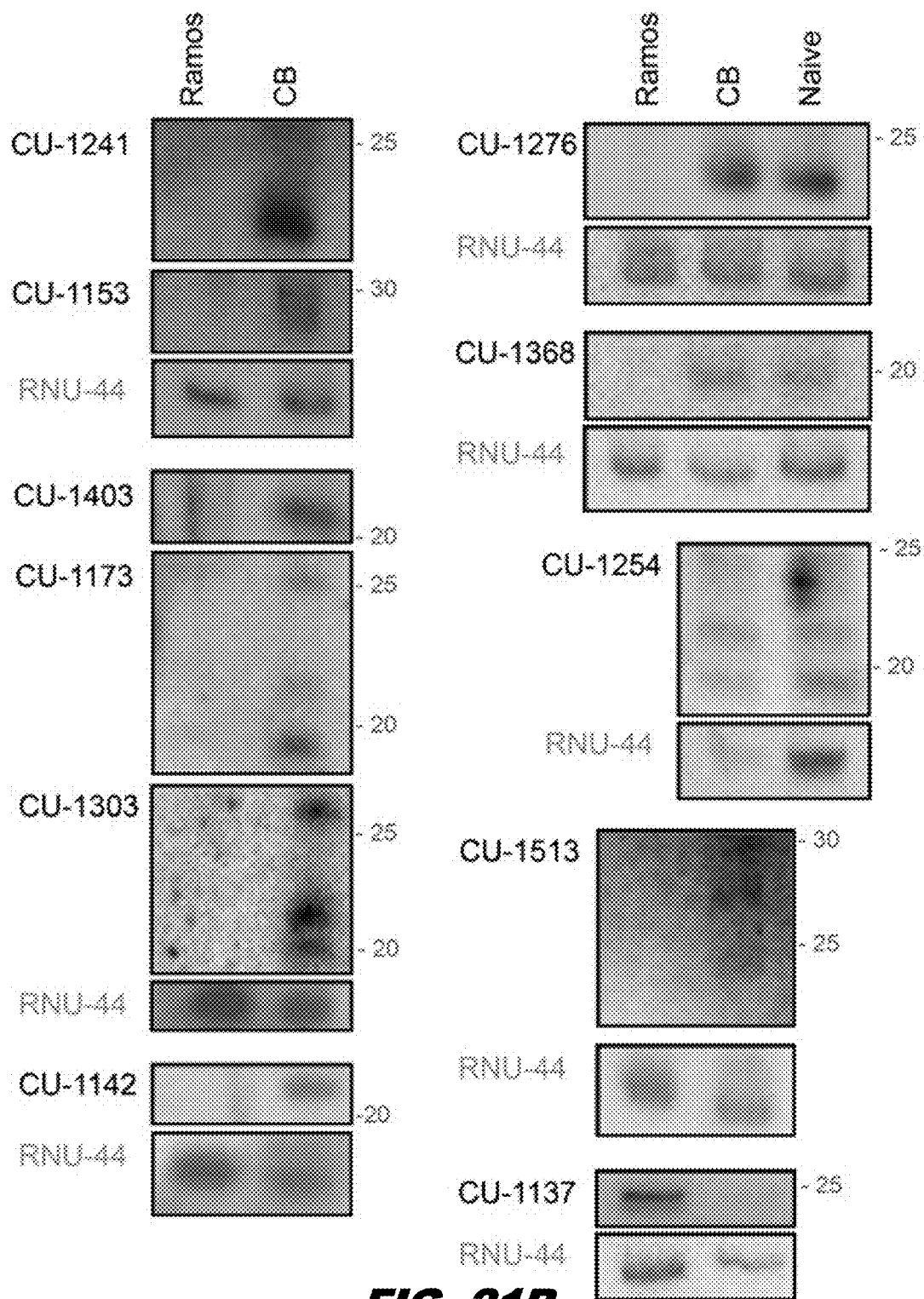
FIG. 21B shows the detection of mature-miRNA species by RNA blot in Ramos cell line, centroblasts (CB) and naïve B cells isolated from human tonsils. RNU44 was used as loading control.

All 75 newly identified miRNAs were investigated by RT-PCR analysis in order to independently validate their existence in vivo in B-cell lines and cells isolated from tonsils. Positive results were obtained in 66 of the cases (see FIG. 21A for representative results and Table 12). Eighteen previously unreported miRNAs were also tested by RNA blot analysis and 11 were detectable (FIG. 21B and Table 12), either using total cellular RNA or upon enrichment for the short-RNA fraction. Overall, 88% of the newly cloned and computationally validated miRNAs were detectable by RNA blot and/or RT-PCR. The validation process also led to the identification of numerous miRNA which are differentially regulated either in normal versus transformed cells (see examples CU-1440, CU-1241, CU-1276 and CU-1137 in FIG. 21) as well as during the GC reaction (FIG. 22).

TABLE 12

Summary of results obtained from the Northern Blot and/or RT-PCR analyses performed on newly identified mature miRNAs cloned multiple times in the B-cell libraries.

| ID | Seq ID No. | Mature miRNA sequence | Northern Blot | RT-PCR |
|---|---|---|---|---|
| CU-1369 | 1764 | TCCCCGGCATCTCCACCA | negative | positive |
| CU-1254 | 1765 | TCCCCGGCACCTCCACCA | positive | positive |
| CU-1298 | 1766 | ATCCCGGACGAGCCCCCA | not tested | positive |
| CU-1303 | 1767 | ATCCCACTTCTGACACCA | positive | positive |
| CU-1173 | 1768 | ATCCCACTCCTGACACCA | positive | positive |
| CU-1242 | 1769 | TCCCCGTACGGGCCACCA | not tested | positive |
| CU-1550 | 1770 | CGGAAGCGTGCTGGGCCC | not tested | positive |
| CU-1186 | 1771 | TCCCCGACACCTCCACCA | not tested | positive |
| CU-1368 | 1772 | GACGAGGTGGCCGAGTGG | positive | positive |
| CU-1243 | 1773 | GTCCCTTCGTGGTCGCCA | not tested | positive |
| CU-1470 | 1774 | CTCCTGGCTGGCTCGCCA | not tested | positive |
| CU-1300 | 1775 | TCCTCACACGGGGCACCA | not tested | positive |
| CU-1264 | 1776 | GAGGGGGACCAAAAAAAA | not tested | negative |
| CU-1212 | 1777 | TCCCCGGCACTTCCACCA | not tested | positive |
| CU-1345 | 1778 | AGAACACTACGAGCCACA | not tested | positive |
| CU-1352 | 1779 | ACCCCACTTCTGGTACCA | negative | positive |
| CU-1363 | 1780 | CGTTCGCGCTTTCCCCTG | not tested | negative |
| CU-1220 | 1781 | TTCCCCGACGGGGAGCCA | not tested | positive |
| CU-1197 | 1782 | ATGTGGTGGCTTACTTTT | not tested | positive |
| CU-1241 | 1783 | AGTCCCATCTGGGTCGCCA | positive | positive |
| CU-1148 | 1784 | TGGTGTGGTCTGTTGTTTT | not tested | positive |
| CU-1288 | 1785 | CGTCCATGATGTTCCGCAA | not tested | positive |
| CU-1528 | 1786 | TAGGGGTATGATTCTCGCT | not tested | negative |
| CU-1175 | 1787 | GGCGTGATTCATACCTTTT | not tested | positive |
| CU-1570 | 1788 | ATCCCCAGCATCTCCACCA | not tested | positive |
| CU-1269 | 1789 | TACCGAGCCTGGTGATAGC | not tested | positive |
| CU-1339 | 1790 | ATCCCCAGCACCTCCACCA | not tested | positive |
| CU-1132 | 1791 | GCCGGGTACTTTCGTATTTT | not tested | negative |
| CU-1370 | 1792 | CTGATTGCTCCTGTCTGATT | not tested | positive |
| CU-1545 | 1793 | CCACGAGGAAGAGAGGTAGC | not tested | negative |
| CU-1307 | 1794 | ACCCCACTATGCTTAGCCCT | not tested | positive |
| CU-1294 | 1795 | AAAGGACCTGGCGGTGCTTC | not tested | positive |
| CU-1371 | 1796 | TCTAGAGGAGCCTGTTCTGTA | not tested | positive |
| CU-1244 | 1797 | GTCAGGATGGCCGAGCGGTCT | not tested | positive |

TABLE 12-continued

Summary of results obtained from the Northern Blot and/or RT-PCR analyses performed on newly identified mature miRNAs cloned multiple times in the B-cell libraries.

| ID | Seq ID No. | Mature miRNA sequence | Northern Blot | RT-PCR |
|---|---|---|---|---|
| CU-1276 | 1798 | TCGATTCCCGGCCAATGCACCA | positive | positive |
| CU-1142 | 1799 | TCGATTCCCGGCCCATGCACCA | positive | positive |
| CU-1379 | 1800 | TCGGGTGCGAGAGGTCCCGGGT | negative | positive |
| CU-1381 | 1801 | TCGATTCCCGGTCAGGGAACCA | not tested | positive |
| CU-1403 | 1802 | GCATTGGTGGTTCAGTGGTAGA | positive | positive |
| CU-1457 | 1803 | TTCTCACTACTGCACTTGACTA | not tested | positive |
| CU-1557 | 1804 | GGAGAGAACGCGGTCTGAGTGGT | not tested | positive |
| CU-1542 | 1805 | GGCTGGTCCGATGGTAGTGGGTT | not tested | positive |
| CU-1221 | 1806 | TGTGCTCCGGAGTTACCTCGTTT | not tested | negative |
| CU-1380 | 1807 | ATAGGTTTGGTCCTAGCCTTTCT | not tested | positive |
| CU-1277 | 1808 | GAGCCATGATGATACCACTGAGC | not tested | positive |
| CU-1281 | 1809 | GCAGCGCCAGCCTCCCGCCCTAC | not tested | positive |
| CU-1524 | 1810 | CCCCCACAACCGCGCTTGACTAGC | not tested | positive |
| CU-1477 | 1811 | CTCCCACTGCTTCACTTGACTAGC | not tested | positive |
| CU-1575 | 1812 | CCCCCCACTGCTAAATTTGACTGGA | not tested | positive |
| CU-1137 | 1813 | GCTAAGGAAGTCCTGTGCTCAGTTTT | positive | positive |
| CU-1538 | 1814 | GGCTGGTCCGAGTGCAGTGGTGTTTA | not tested | positive |
| CU-1153 | 1815 | CCCCCCACTGCTAAATTTGACTGGCTT | positive | positive |
| CU-1513 | 1816 | GCGGGTGATGCGAACTGGAGTCTGAGC | positive | positive |
| CU-1293 | 1817 | AGCAGTGATGTCCTGAAAATTCTGAAG | not tested | negative |
| CU-1388 | 1818 | TCCCTGGTGGTCTAGTGGTTAGGATTCG | negative | positive |
| CU-1180 | 1819 | AACCGAGCGTCCAAGCTCTTTCCATTTT | not tested | positive |
| CU-1382 | 1820 | TCCTCGTTAGTATAGTGGTGAGTATCCC | negative | positive |
| CU-1251 | 1821 | CCCACCCAGGGACGCCA | negative | positive |
| CU-1191 | 1822 | GCCCGCATCCTCCACCA | negative | positive |
| CU-1453 | 1823 | CCCTGCTCGCTGCGCCA | not tested | positive |
| CU-1222 | 1824 | TCACGTCGGGGTCACCA | not tested | Positive |
| CU-1178 | 1825 | AGGGTGTGCGTGTTTTT | not tested | Positive |
| CU-1488 | 1826 | TCCTGCCGCGGTCGCCA | not tested | Positive |
| CU-1164 | 1827 | GAGAGCGCTCGGTTTTT | not tested | Negative |
| CU-1486 | 1828 | CTGCTGTGATGACATTC | not tested | Positive |
| CU-1130 | 1829 | CCCGGGTTTCGGCACCA | not tested | Positive |

TABLE 12-continued

Summary of results obtained from the Northern Blot and/or RT-PCR analyses performed on newly identified mature miRNAs cloned multiple times in the B-cell libraries.

| ID | Seq ID No. | Mature miRNA sequence | Northern Blot | RT-PCR |
|---|---|---|---|---|
| CU-1155 | 1830 | TCCCCGCACCTCCACCA | not tested | Positive |
| CU-1278 | 1831 | TAACGGCCGCGGTACCC | not tested | Positive |
| CU-1246 | 1832 | AGGGGGGTAAAAAAAAA | not tested | Positive |
| CU-1440 | 1833 | TGGTTATCACGTTCGCC | not tested | Positive |
| CU-1213 | 1834 | TCACCCCATAAACACCA | not tested | Positive |
| CU-1146 | 1835 | AGAAAGGCCGAATTTTA | not tested | Positive |
| CU-1323 | 1836 | TGTATTGTGAGACATTC | not tested | Positive |
| CU-1324 | 1837 | TCTCGGTGGAACCTCCA | not tested | Positive |
| CU-1396 | 1838 | TAAGTGTTTGTGGGTTA | not tested | negative |

Figure 25:
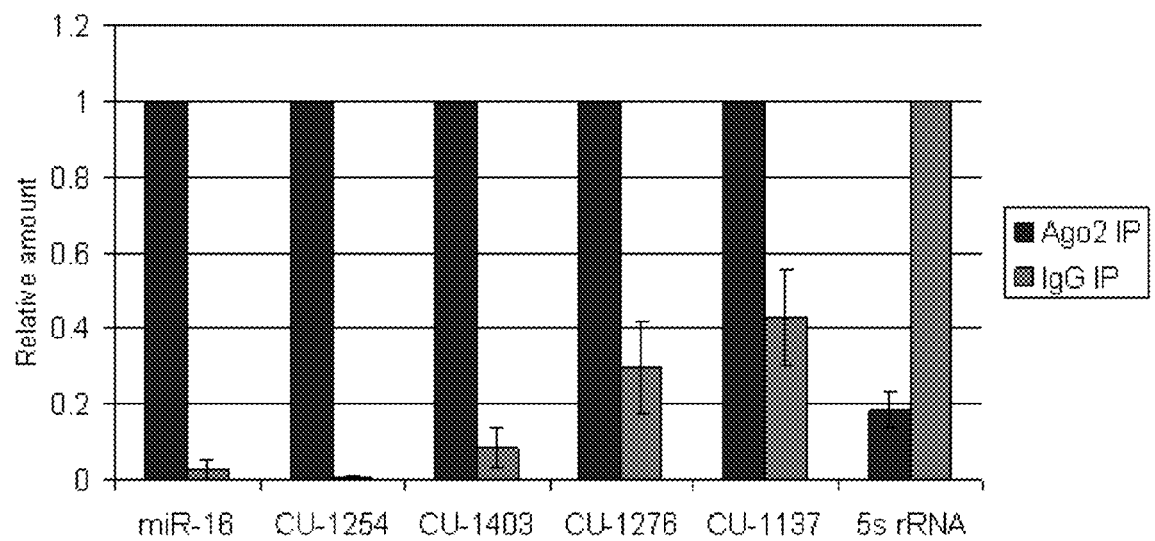
FIG. 25 is a bar graph that shows new miRNAs are found in association with Ago2 protein complex. New miRNAs as well as known (miR-16) are enriched in Ago2 compared to control IgG immunoprecipitates (IP). The binding is specific since other RNA species (5s rRNA) are not enriched in the Ago2 immunoprecipitates. Bars represent the internally normalized average of two independent qPCR assays, each from two sets of three pooled immunoprecipitations. Error bars are the standard deviation of the measurements. The 4 new miRNAs found to be associated with the Ago2 complex are representative of miRNA cloned at higher level in non-GC B cells (CU-1254), in GC B cells (CU-1403; CU-1276) or aberrantly over-expressed in Ramos Burkitt lymphoma cells (CU-1137).

In order to gain preliminary evidence of the functionality of the previously unreported miRNAs, a small subset of these miRNAs which were fully validated at the expression level was tested for incorporation in the functional miRNA-mRNA complex by co-immunoprecipitation with Ago2 proteins (Mourelatos et al., 2002). The results showed that the RNA fraction associated with the Ago complex was indeed enriched for each of the four tested previously unreported miRNAs (FIG. 25), confirming that the identified sequences enter the expected miRNA functional pathway.

Figure 26:
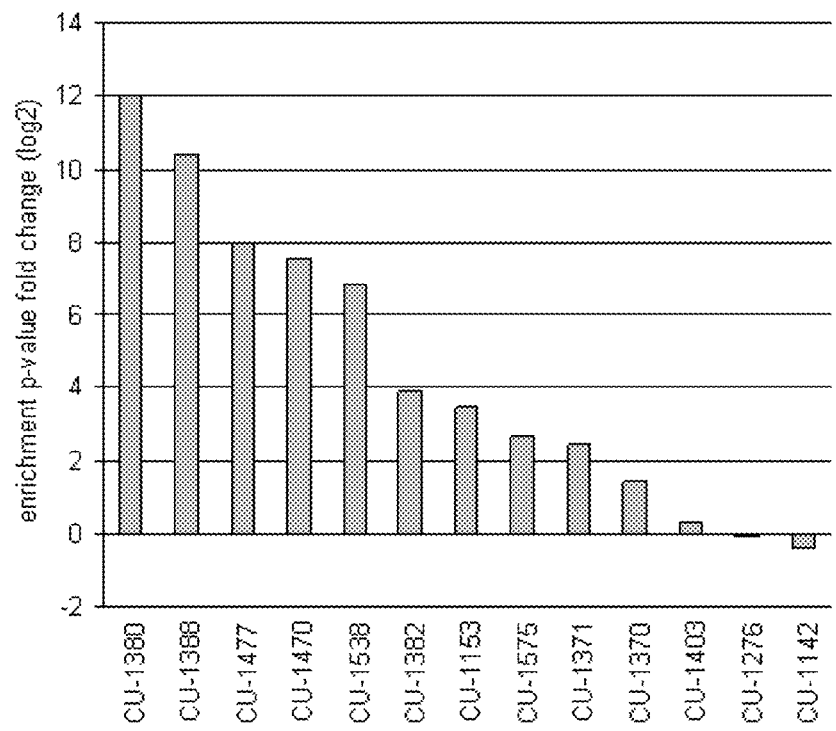
FIG. 26 is a bar graph that shows enrichment for predicted miRNA targets in genes down-regulated in GC compared to Naïve B cells. Target prediction was performed for 15 new miRNAs expressed at higher level in GC compared to naïve B cells (>3 fold) by miRanda v1.0 and RNA22. Targets predicted by both algorithms were tested for enrichment in the down-regulated genes of the GC transcriptome. Eleven out of 15 GC-over-expressed miRNAs showed an increase in their candidate target enrichment p-value in GC vs naïve down-regulated genes compared to control populations (memory vs naïve), two showed a decrease and two showed no differences. Enrichment p-values are reported in Table 13.

Indirect clues on the functionality of miRNAs may also be obtained analyzing the effect of stage-specific miRNAs on the corresponding transcriptome since most miRNAs have been showed to affect the expression of their targets albeit to a modest degree (Filipowicz et al., 2008). Toward this end, the targets of 15 previously unreported GC-over-expressed miRNAs were predicted by two algorithms (miRanda and RNA22) (John et al., 2004; Miranda et al., 2006) and were tested for enrichment in genes down-regulated in GC versus naïve B cells. Eleven out of 15 miRNA showed an increase (and only two a decrease) in their candidate target enrichment p-value for GC down-regulated genes compared to control populations (FIG. 26 and Table 13). These results suggest that indeed miRNAs associated with GC B cells specifically affect the GC transcriptome.

TABLE 13

Enrichment for predicted miRNA targets in genes downregulated in CB and in memory compared to naïve B cells.

| CB over-expressed miRNA | Targets enrichment in genes downregulated in CB vs N (p-value) | Targets enrichment in genes downregulated in M vs N (p-value) |
|---|---|---|
| CU-1380 | 0.0001 | 0.4079 |
| CU-1388 | 0.0002 | 0.2699 |
| CU-1477 | 0.0002 | 0.0514 |
| CU-1538 | 0.0014 | 0.1609 |
| CU-1142 | 0.0016 | 0.0012 |
| CU-1382 | 0.0016 | 0.0242 |
| CU-1403 | 0.0026 | 0.0032 |
| CU-1470 | 0.0029 | 0.5392 |
| CU-1276 | 0.0193 | 0.0187 |
| CU-1371 | 0.0413 | 0.2252 |
| CU-1153 | 0.091 | 1 |

TABLE 13-continued

Enrichment for predicted miRNA targets in genes downregulated in CB and in memory compared to naïve B cells.

| CB over-expressed miRNA | Targets enrichment in genes downregulated in CB vs N (p-value) | Targets enrichment in genes downregulated in M vs N (p-value) |
|---|---|---|
| CU-1575 | 0.1598 | 1 |
| CU-1370 | 0.1708 | 0.4595 |
| CU-1303 | 1 | 1 |
| CU-1513 | 1 | 1 |

In summary, previously unreported miRNAs identified by cloning and computational analysis were validated at the expression level by multiple detection methods. For a small subset tested, their incorporation in the Ago complex and their activity on the GC transcriptome suggests biological functionality.

Transcriptional and Post-Transcriptional Regulation.

Most newly identified miRNAs tested by RNA blot showed a long abundant transcript (>150 nt) likely corresponding to the primary miRNA transcript and a second transcript (~60-80 nt) consistent with the precursor miRNA. As shown in FIG. 21C (top panel), the precursor miRNA and the correspondent mature miRNA may be produced in some cell type but not in others, suggesting transcriptional regulation. Conversely, the relative abundance of precursor and mature miRNA was different is some cell types (FIG. 21C, bottom panel) suggesting the existence of post-transcriptional regulation most likely targeting the Dicer-dependent pre-miRNA processing (Lee et al., 2007; Michael et al., 2003; Thomson et al., 2006).

Taken together, these observations suggest that the expression of mature miRNAs may be affected by both transcriptional and post-transcriptional regulatory mechanisms.

Distinct miRNA Signatures in Normal B-Cell Subpopulations.

In order to further investigate whether specific miRNA regulation occurred in normal B-cell development or in transformed cells, miRNA representation was examined in libraries constructed from naïve, GC and memory B cells, as well as from the Ramos BL cell line. Differential expression of numerous known and newly identified miRNAs was evident during B-cell differentiation and GC transit as shown by hierarchical clustering using miRNA frequencies (defined as the fraction of the total pool of cloned miRNAs represented by a given miRNA in a library) obtained from the cloning data (FIG. 22A). Naïve and memory B cells appeared similar, sharing a large fraction of the most abundant miRNAs. Conversely, centroblasts showed a more distinct miRNA profile with a sizeable fraction of abundant miRNAs being specifically expressed in the CB library, suggesting specific functions. Some miRNAs were expressed in the GC-derived Ramos cells, but not in normal GC B cells, or vice versa in the normal but not in the tumor cells, suggesting that malignant transformation affects miRNA expression.

Figure 27:
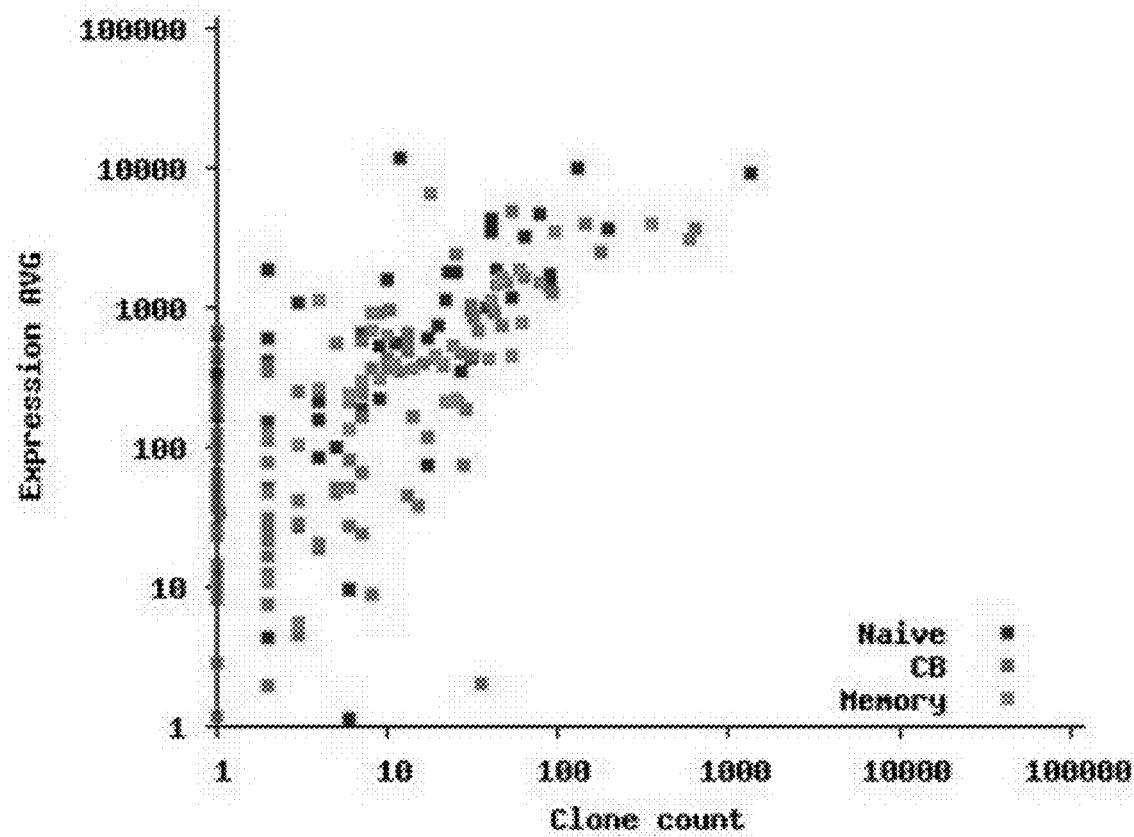
FIG. 27 is a plot showing the correlation measurement between cloning and miRNA expression array data. miRNA normalized clone counts and average expressions measured by miRNA expression arrays are represented in a scatter plot format. The plot includes data for miRNAs which have been cloned more than once and were represented on the Agilent Human miRNA Microarray. Overall, this analysis include 89 miRNA sequences distributed as following in the three libraries: 54 in naïve, 80 in centroblasts (CB) and 48 in memory. The Spearman correlation is 0.7 corresponding to a p-value <3.9e-28.
Figure 28:
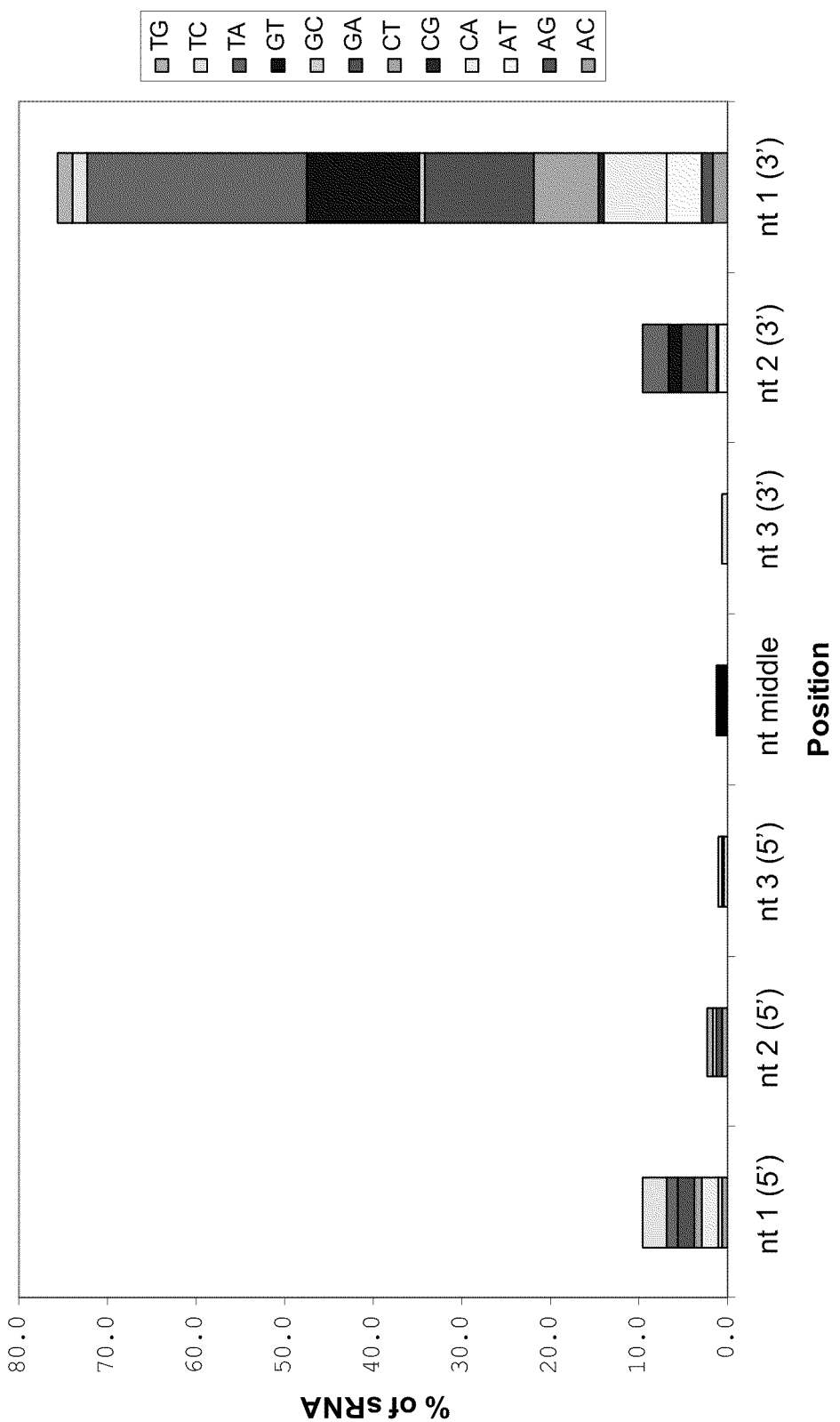
FIG. 28 is a bar graph showing the analysis of single nucleotide mismatches identified in cloned known miRNA. The plot represents the percentage of short-RNA corresponding to known miRNA and displaying mismatches to the human genome. Nucleotide in position 1 to 3 starting from both 5'- and 3'-end as well as all remaining middle nucleotides (nt middle) of each sRNA were analyzed for single substitutions.

To independently validate results of the cloning experiment, miRNA expression profiling was performed of centroblasts, naïve and memory B cells (six donors/each) using a commercial microarray representative of 723 known human miRNAs (miRBase v.10.1). The Spearman correlation between cloning and microarray data is 0.7 corresponding to a p-value <3.9e-28 (FIG. 27). Each B-cell population showed a distinct miRNA expression profile. Consistent with the cloning data (FIG. 22A), GC B cells appeared to be quite distinct from naïve and memory B cells, which instead shared expression of a large fraction of miRNAs (FIG. 22B). The expression of several miRNAs was tested by qRT-PCR analysis, which confirmed that the microarray data were quantitatively accurate. Overall, these results show that the GC reaction is characterized by the specific expression of multiple miRNAs.

Discussion

The combination of cloning procedures and computational tools used in this study led to the identification of a large fraction of miRNA expressed during B-cell differentiation. These included 75 previously unreported miRNAs, as well as a potentially distinct class of short-RNAs not fulfilling current criteria for miRNAs. These findings have general implications for the understanding of the total miRNA content of the human genome as well as for future studies on the role of miRNAs in B-cell differentiation, function and lymphomagenesis.

The discovery of 75 previously unreported miRNAs expressed in normal and/or malignant B cells is in contrast with a previous study that reported the discovery of only 12 new human miRNA (Landgraf et al., 2007) from an analysis of a large panel of different organ systems and cell types and suggested that most miRNAs have already been identified and are ubiquitously expressed (Landgraf et al., 2007). These discordant results and conclusions may be due i) to the higher number of clones per library sequenced in this study (3500 versus 1300 on average in (Landgraf et al., 2007)), which allowed the detection of low-abundance miRNA species and ii) to the criteria applied in the miRNA identification which do not include conservation and allow consideration of repetitive elements (see Supplemental Experimental Procedures in Example 3). Moreover, the relatively lower degree of evolutionary conservation of previously unreported miRNAs may have prevented the cross-species identification of miRNAs using murine libraries (Chen et al., 2004; Neilson et al., 2007). Consistent with these observations, a recent report on short-RNAs in mouse embryonic stem cells discovered Dicer-dependent miRNAs characterized by both low abundance and low degree of conservation (Calabrese et al., 2007). Since 88% of the previously unreported miRNAs have been independently detected by RT-PCR and/or RNA blot analyses, our cloning and computational approach is largely validated.

We note that a fraction of the validated miRNAs display similarity to the 3'-end of post-transcriptionally modified tRNAs, raising the possibility that they may derive from loci with t-RNA homology or by direct processing of t-RNAs. We also identified a large set of candidate miRNAs (101 unreported, to our knowledge, and 27 known) that have been cloned as single occurrences in the B-cell libraries (Table 7). This group of candidate miRNAs has not yet been fully investigated, but nevertheless they may include bona fide miRNAs because 3 out of 3 tested were detectable by RNA blot or RT-PCR analyses. Thus, our data in B cells suggest that a large number of low-abundance, recently evolved, tissue-specific miRNAs remain to be discovered.

Two categories of short-RNAs were identified that could not be annotated as bona fide miRNAs. The first category is represented by short-RNAs which display all features required by the computational pipeline to be defined as candidate miRNAs, but nevertheless have an atypical length (<17 nt or >28 nt; 75 candidate miRNAs). Sequences belonging to this first category may include bona fide miRNAs since 2 out of 2 tested were detectable by RT-PCR. The second category is represented by those short-RNAs for which classic pre-miRNA structures could not be identified in the genome and no similarity to other non-coding RNA was found in the available databases. These short-RNAs may either be miRNA for which RNA secondary structure prediction algorithms failed to predict the correct hairpin structure or may represent new miRNA species of presently unknown mechanism of generation or other not yet described types of short-RNAs.

Finally, this analysis led to the discovery of short-RNAs that could not be accurately mapped to the genome. Considering that a fraction of these RNAs were cloned multiple times and showed a stage-specific behavior, we suggest that such short-RNAs do actually exist and that the lack of a match to the human genome may be due to polymorphisms, editing and other post-transcriptional modifications or to an incomplete or inaccurate sequencing of the corresponding genomic regions.

The specificity in mature miRNA expression appears to be regulated at the transcriptional as well as at the post-transcriptional, i.e. pre-miRNA processing, level. Indeed, the accumulation of pre-miRNA in absence of a mature miRNA can occur in a cell type-restricted manner, suggesting the presence of a mechanism of regulation at the pre-miRNA processing step. Both regulatory mechanisms may act during normal differentiation and may also be dysregulated during transformation as a consequence of genetic or epigenetic alterations (Lee et al., 2007; Michael et al., 2003; Thomson et al., 2006). Indeed, miRNAs CU-1137 and CU-1368 represent examples of transcriptional activation and post-transcriptional silencing associated with malignant transformation, respectively.

The stage-specific expression of various miRNAs strongly suggests highly specialized regulatory functions in B-cell biology. The role of miRNAs that show cell type-specific functions in lymphocytes has just begun to be elucidated (Dorsett et al., 2008; Li et al., 2007; Rodriguez et al., 2007; Teng et al., 2008; That et al., 2007; Xiao et al., 2007). The miRNAs specifically associated with GC or non-GC B cells by either cloning or miRNA expression profiling have not been previously reported in B-cell differentiation with the exception of miR-150 (Xiao et al., 2007). For example the miR-199 and miR-125 families as well as miR-138 show a distinct expression in GC B cells although none of these miRNAs has been investigated for a role in this cell compartment. The extent of post-transcriptional regulation added by miRNAs will be fully uncovered only in the context of the complex network of cellular interactions (Basso et al., 2005), which will require the integration of large scale gene and miRNA expression data.

miRNA expression can be affected by malignant transformation. For instance, the miR-17-92 cluster, previously reported as a potential oncogene (He et al., 2005), was found over-expressed in Ramos cell line compared to GC B cells. Moreover, several miRNAs (i.e. CU-1137, CU-1148) show expression in Ramos cells and in several additional BL cell lines, but not in their normal GC counterpart. Vice versa, as observed for the miR-199 family, the expression of some miRNAs is lost in the tumor cells. The data herein represents a useful basis to investigate whether lymphoma-associated chromosomal lesions affect genomic regions associated with miRNA expression.

Finally, the differences in miRNA expression profile between GC and non-GC B cells resembled those observed by expression profiling of coding genes (Klein et al., 2003), consistent with the previous observation that miRNA profiling may be equally or more informative in discriminating tumor phenotypes (Calin et al., 2005; Lu et al., 2005). This suggests that miRNA expression profiling, especially if including new B-cell specific miRNAs, may be useful in the differential diagnosis of lymphoid malignancies.

The expanded B-cell miRNome described here represents a resource which can be used to identify miRNAs expressed during the GC transit as well as specific differences in miRNA expression in normal versus lymphoma cells, and which can guide studies to unveil the function of miRNAs in normal B cell development and lymphomagenesis.

Experimental Procedures

Generation of Short-RNA Libraries.

Purification of naïve, memory and GC B cells was performed as previously reported (Klein et al., 2003) using magnetic cell sorting of mononucleated cells obtained from human tonsils. Total RNA was purified using the Trizol Reagent (Invitrogen) following the manufacturer's indications. The short-RNA libraries were generated using an established protocol described in detail in (Lau et al., 2001). Briefly, total RNA was separated on 15% polyacrylamide gel and the fragment corresponding to 15-30 nucleotides length was excised. The purified small RNAs were linked to adaptor oligonucleotides and gel purified. Upon adaptor ligation, RNA was reverse transcribed and cDNA was PCR amplified and cloned into pCR2.1-TOPO vector (Invitrogen). Sequencing was performed on colony PCR amplicons.

Computational Identification of Precursor and Mature miRNAs.

The bioinformatics miRNA analysis pipeline (FIG. 18) includes: (a) identification of short-RNAs from each library, (b) identification of exact and partial matches of the short-RNA sequences to the human genome, (c) testing each short-RNA genomic region for compatibility with hairpin secondary structures, (d) clustering genomic regions to predict mature miRNAs, (e) annotating and filtering short-RNAs and miRNAs candidates, (f) estimation of predicted miRNA frequencies in the libraries and (g) clustering short-RNAs that do not support miRNA candidates. The details are reported in the Supplemental Experimental Procedures in Example.

Orthology Analysis.

The identification of putative orthologous sequences of known and predicted precursor and mature human miRNAs in chimp (panTro2), monkey (rheMac2), dog (canFam2), mouse (mm8) and rat (rn4) was performed using UCSC-provided Blastz (Schwartz et al., 2003) pairwise alignments between human and target species. The details are reported below.

miRNA Expression Profiling.

The miRNA expression profiles were generated using the Human miRNA Microarray kit (Agilent Technologies) that allows detection of 723 known human (miRBase v.10.1) and 76 human viral miRNAs, following the manufacturer's indications. Analysis of raw data was performed using the Feature Extraction Software 9.5.3.1 (Agilent Technologies). The dendrograms (FIG. 22) were generated using a hierarchical clustering algorithm based on the average-linkage method (Eisen et al., 1998; Hartigan, 1975) and Spearman's correlation as provided by the geWorkbench platform (http://www.geworkbench.org).

RT-PCR Analysis.

Small RNA fractions were purified using the Trizol Reagent (Invitrogen) and the PureLink miRNA Isolation Kit (Invitrogen), following the manufacturer's indications. RT-PCR was performed as previously described (Sharbati-Tehrani et al., 2008). Briefly, miRNA sequences were reverse-transcribed from 50 ng short-RNA using Superscript III First Strand Synthesis Kit (Invitrogen), in the presence of 0.2 µM RTFS primer (miRNA-specific primers, see Table 14). $\frac{1}{10}^{th}$ of the cDNA volume was then used as template for 34 cycles of PCR amplification in the presence of 4 nM SS primer (miRNA-specific primers, see Table 14) and 0.4 µM each of MPF and MPR universal primers (Table 14). PCR products were separated on 12% non-denaturing polyacrylamide gel, detected by SybrGold (1:10,000 dilution; Invitrogen) and visualized under UV light.

TABLE 14

List of probes and primers used for Northern Blot and RT-PCR analyses, respectively.

| ID | Seq ID No. | mature miRNA sequence (5'-3') | Seq ID No. | Probe sequence (5'-3') | Hybridization Temperature [° C.] |
|---|---|---|---|---|---|
| CU-1137 | 1839 | GCTAAGGAAGTCCT GTGCTCAGTTTT | 1926 | AAAACTGAGCACAGGACTT CCTTAGC | 60 |
| CU-1142 | 1840 | TCGATTCCCGGCCC ATGCACCA | 1927 | TGGTGCATGGGCCGGGAAT CGA | 55 |
| CU-1153 | 1841 | CCCCCCACTGCTAA ATTTGACTGGCTT | 1928 | AAGCCAGTCAAATTTAGCA GTGGGGGG | 50 |
| CU-1173 | 1842 | ATCCCACTCCTGAC ACCA | 1929 | TGGTGTCAGGAGTGGGAT | 50 |

TABLE 14-continued

List of probes and primers used for Northern Blot and RT-PCR analyses, respectively.

| ID | Seq ID No. | Probe sequence | Seq ID No. | Primer sequence | Temp |
|---|---|---|---|---|---|
| CU-1241 | 1843 | AGTCCCATCTGGGTCGCCA | 1930 | TGGCGACCCAGATGGGACT | 55 |
| CU-1254 | 1844 | TCCCCGGCACCTCCACCA | 1931 | TGGTGGAGGTGCCGGGGA | 55 |
| CU-1276 | 1845 | TCGATTCCCGGCCAATGCACCA | 1932 | TGGTGCATTGGCCGGGAATCGA | 60 |
| CU-1303 | 1846 | ATCCCACTTCTGACACCA | 1933 | TGGTGTCAGAAGTGGGAT | 50 |
| CU-1368 | 1847 | GACGAGGTGGCCGAGTGG | 1934 | AACCACTCGGCCACCTCGTC | 60 |
| CU-1403 | 1848 | GCATTGGTGGTTCAGTGGTAGA | 1935 | TCTACCACTGAACCACCAATGC | 60 |
| CU-1513 | 1849 | GCGGGTGATGCGAACTGGAGTCTGAGC | 1936 | GCTCAGACTCCAGTTCGCATCACCCGC | 50 |

| ID | Seq ID No. | mature miRNA sequence (5'-3') | Seq ID No. | RTFS primer sequence (5'-3') | SS primer sequence (5'-3') |
|---|---|---|---|---|---|
| CU-1130 | 1850 | CCCGGGTTTCGGCACCA | 1937 | TGTCAGGCAACCGTATTCACCGTGAGTGGTTGGTGC | SEQ ID NO: 2013 CGTCAGATGTCCGAGTAGAGGGGGAACGGCGCCCGGGTTTCG |
| CU-1132 | 1851 | GCCGGGTACTTTCGTATTTT | 1938 | TGTCAGGCAACCGTATTCACCGTGAGTGGTAAAATACG | SEQ ID NO: 2014 CGTCAGATGTCCGAGTAGAGGGGGAACGGCGGCCGGGTACTTT |
| CU-1137 | 1852 | GCTAAGGAAGTCCTGTGCTCAGTTTT | 1939 | TGTCAGGCAACCGTATTCACCGTGAGTGGTAAAACTGAGC | SEQ ID NO: 2015 CGTCAGATGTCCGAGTAGAGGGGGAACGGCGGCTAAGGAAGTCCTGT |
| CU-1138 | 1853 | TATCAATGATGCTTCTGAGA | 1940 | TGTCAGGCAACCGTATTCACCGTGAGTGGTTCTCAG | SEQ ID NO: 2016 CGTCAGATGTCCGAGTAGAGGGGGAACGGCGTATCAATGATGCTT |
| CU-1142 | 1854 | TCGATTCCCGGCCCATGCACCA | 1941 | TGTCAGGCAACCGTATCACCGTGAGTGGTTTGGTGC | SEQ ID NO: 2017 CGTCAGATGTCCGAGTAGAGGGGGAACGGCGTCGATTCCCGGCCCAT |
| CU-1146 | 1855 | AGAAAGGCCGAATTTTA | 1942 | TGTCAGGCAACCGTATTCACCGTGAGTG[GTTAAAATTCGG | SEQ ID NO: 2018 CGTCAGATGTCCGAGTAGAGGGGGAACGGCGAGAAAGGCCG |
| CU-1148 | 1856 | TGGTGTGGTCTGTTGTTTT | 1943 | TGTCAGGCAACCGTATTCACCGTGAGTGGTAAAACAACAG | SEQ ID NO: 2019 CGTCAGATGTCCGAGTAGAGGGGGAACGGCGTGGTGTGGTCTG |
| CU-1153 | 1857 | CCCCCCACTGCTAAATTTGACTGGCTT | 1944 | TGTCAGGCAACCGTATTCACCGTGAGTGGTAAGCCA | SEQ ID NO: 2020 CGTCAGATGTCCGAGTAGAGGGGGAACGGCGCCCCCCACTGCTAAATTTG |
| CU-1155 | 1858 | TCCCCGCACCTCCACCA | 1945 | TGTCAGGCAACCGTATTCACCGTGAGTGGTTGGTGG | SEQ ID NO: 2021 CGTCAGATGTCCGAGTAGAGGGGGAACGGCGTCCCCGCACCT |
| CU-1164 | 1859 | GAGAGCGCTCGGTTTTT | 1946 | TGTCAGGCAACCGTATTCACCGTGAGTGGTAAAAACCG | SEQ ID NO: 2022 CGTCAGATGTCCGAGTAGAGGGGGAACGGCGGAGAGCGCT |
| CU-1173 | 1860 | ATCCCACTCCTGACACCA | 1947 | TGTCAGGCAACCGTATTCACCGTGAGTGGTTGGTGT | SEQ ID NO: 2023 CGTCAGATGTCCGAGTA |

TABLE 14-continued

List of probes and primers used for Northern Blot and RT-PCR analyses, respectively.

| | | | | | |
|---|---|---|---|---|---|
| | | | | | GAGGGGGAACGGCGATC CCACTCCTG |
| CU-1175 | 1861 | GGCGTGATTCATAC CTTTT | 1948 | TGTCAGGCAACCGTATTCA CCGTGAGTGGTAAAAGGTA TG | SEQ ID NO: 2024 CGTCAGATGTCCGAGTA GAGGGGGAACGGCGGGC GTGATTCAT |
| CU-1178 | 1862 | AGGGTGTGCGTGTT TTT | 1949 | TGTCAGGCAACCGTATTCA CCGTGAGTG[GTAAAAACA CGC | SEQ ID NO: 2025 CGTCAGATGTCCGAGTA GAGGGGGAACGGCGAGG GTGTGCGT |
| CU-1180 | 1863 | AACCGAGCGTCCAA GCTCTTTCCATTTT | 1950 | TGTCAGGCAACCGTATTCA CCGTGAGTGGTAAAATG | SEQ ID NO: 2026 CGTCAGATGTCCGAGTA GAGGGGGAACGGCGAAC CGAGCGTCCAAGCTCT |
| CU-1186 | 1864 | TCCCCGACACCTCC ACCA | 1951 | TGTCAGGCAACCGTATTCA CCGTGAGTGGTTGGTGG | SEQ ID NO: 2027 CGTCAGATGTCCGAGTA GAGGGGGAACGGCGTCC CCGACACCT |
| CU-1191 | 1865 | GCCCGCATCCTCCA CCA | 1952 | TGTCAGGCAACCGTATTCA CCGTGAGTGGTTGGTGG | SEQ ID NO: 2028 CGTCAGATGTCCGAGTA GAGGGGGAACGGCGGCC CGCATCCT |
| CU-1197 | 1866 | ATGTGGTGGCTTAC TTTT | 1953 | TGTCAGGCAACCGTATTCA CCGTGAGTGGTAAAAGTAA GC | SEQ ID NO: 2029 CGTCAGATGTCCGAGTA GAGGGGGAACGGCGATG TGGTGGCTT |
| CU-1212 | 1867 | TCCCCGGCACTTCC ACCA | 1954 | TGTCAGGCAACCGTATTCA CCGTGAGTGGTTGGTGG | SEQ ID NO: 2030 CGTCAGATGTCCGAGTA GAGGGGGAACGGCGTCC CCGGCACTT |
| CU-1213 | 1868 | TCACCCCATAAACA CCA | 1955 | TGTCAGGCAACCGTATTCA CCGTGAGTGGTTGGTGT | SEQ ID NO: 2031 CGTCAGATGTCCGAGTA GAGGGGGAACGGCGTCA CCCCATAA |
| CU-1220 | 1869 | TTCCCCGACGGGGA GCCA | 1956 | TGTCAGGCAACCGTATTCA CCGTGAGTGGTTGGCTC | SEQ ID NO: 2032 CGTCAGATGTCCGAGTA GAGGGGGAACGGCGTTC CCCGACGGG |
| CU-1221 | 1870 | TGTGCTCCGGAGTT ACCTCGTTT | 1957 | TGTCAGGCAACCGTATTCA CCGTGAGTGGTAAACGAGG | SEQ ID NO: 2033 CGTCAGATGTCCGAGTA GAGGGGGAACGGCGTGT GCTCCGGAGTTA |
| CU-1222 | 1871 | TCACGTCGGGGTCA CCA | 1958 | TGTCAGGCAACCGTATTCA CCGTGAGTGGTTGGTGA | SEQ ID NO: 2034 CGTCAGATGTCCGAGTA GAGGGGGAACGGCGTCA CGTCGGGG |
| CU-1241 | 1872 | AGTCCCATCTGGGT CGCCA | 1959 | TGTCAGGCAACCGTATTCA CCGTGAGTGGTTGGCGA | SEQ ID NO: 2035 CGTCAGATGTCCGAGTA GAGGGGGAACGGCGAGT CCCATCTGGG |
| CU-1242 | 1873 | TCCCCGTACGGGCC ACCA | 1960 | TGTCAGGCAACCGTATTCA CCGTGAGTGGTTGGTGG | SEQ ID NO: 2036 CGTCAGATGTCCGAGTA GAGGGGGAACGGCGTCC CCGTACGGG |
| CU-1243 | 1874 | GTCCCTTCGTGGTC GCCA | 1961 | TGTCAGGCAACCGTATTCA CCGTGAGTGGTTGGCGA | SEQ ID NO: 2037 CGTCAGATGTCCGAGTA GAGGGGGAACGGCGGTC CCTTCGTGG |
| CU-1244 | 1875 | GTCAGGATGGCCGA GCGGTCT | 1962 | TGTCAGGCAACCGTATTCA CCGTGAGTGGTAGACCG | SEQ ID NO: 2038 CGTCAGATGTCCGAGTA GAGGGGGAACGGCGGTC AGGATGGCCGAG |

TABLE 14-continued

List of probes and primers used for Northern Blot and RT-PCR analyses, respectively.

| | | | | |
|---|---|---|---|---|
| CU-1246 | 1876 AGGGGGGTAAAAAA AAA | 1963 | TGTCAGGCAACCGTATTCA CCGTGAGTGGTTTTTTT | SEQ ID NO: 2039 CGTCAGATGTCCGAGTA GAGGGGGAACGGCGAGG GGGTAAA |
| CU-1251 | 1877 CCCACCCAGGGACG CCA | 1964 | TGTCAGGCAACCGTATTCA CCGTGAGTGGTTGGCGT | SEQ ID NO: 2040 CGTCAGATGTCCGAGTA GAGGGGGAACGGCGCCC ACCCAGGG |
| CU-1254 | 1878 TCCCCGGCACCTCC ACCA | 1965 | TGTCAGGCAACCGTATTCA CCGTGAGTGGTTGGTGG | SEQ ID NO: 2041 CGTCAGATGTCCGAGTA GAGGGGGAACGGCGTCC CCGGCACCT |
| CU-1264 | 1879 GAGGGGGACCAAAA AAAA | 1966 | TGTCAGGCAACCGTATTCA CCGTGAGTGGTTTTTTTTT GG | SEQ ID NO: 2042 CGTCAGATGTCCGAGTA GAGGGGGAACGGCGGAG GGGGA |
| CU-1269 | 1880 TACCGAGCCTGGTG ATAGC | 1967 | TGTCAGGCAACCGTATTCA CCGTGAGTGGTGCTATC | SEQ ID NO: 2043 CGTCAGATGTCCGAGTA GAGGGGGAACGGCGTAC CGAGCCTGGT |
| CU-1276 | 1881 TCGATTCCCGGCCA ATGCACCA | 1968 | TGTCAGGCAACCGTATTCA CCGTGAGTGGTTGGTGCAT TG | SEQ ID NO: 2044 CGTCAGATGTCCGAGTA GAGGGGGAACGGCGTCG ATTCCCGGC |
| CU-1277 | 1882 GAGCCATGATGATA CCACTGAGC | 1969 | TGTCAGGCAACCGTATTCA CCGTGAGTGGTGCTCAG | SEQ ID NO: 2045 CGTCAGATGTCCGAGTA GAGGGGGAACGGCGGAG CCATGATGATACCA |
| CU-1278 | 1883 TAACGGCCGCGGTA CCC | 1970 | TGTCAGGCAACCGTATTCA CCGTGAGTGGTGGGTAC | SEQ ID NO: 2046 CGTCAGATGTCCGAGTA GAGGGGGAACGGCGTAA CGGCCGCG |
| CU-1281 | 1884 GCAGCGCCAGCCTC CCGCCCTAC | 1971 | TGTCAGGCAACCGTATTCA CCGTGAGTGGTGTAGGG | SEQ ID NO: 2047 CGTCAGATGTCCGAGTA GAGGGGGAACGGCGGCA GCGCCAGCCTCCCG |
| CU-1288 | 1885 CGTCCATGATGTTC CGCAA | 1972 | TGTCAGGCAACCGTATTCA CCGTGAGTGGTTTGCGG | SEQ ID NO: 2048 CGTCAGATGTCCGAGTA GAGGGGGAACGGCGCGT CCATGATGTT |
| CU-1293 | 1886 AGCAGTGATGTCCT GAAAATTCTGAAG | 1973 | TGTCAGGCAACCGTATTCA CCGTGAGTGGTCTTCAGAA TTT | SEQ ID NO: 2049 CGTCAGATGTCCGAGTA GAGGGGGAACGGCGAGC AGTGATGTCCTGA |
| CU-1294 | 1887 AAAGGACCTGGCGG TGCTTC | 1974 | TGTCAGGCAACCGTATTCA CCGTGAGTGGTGAAGCA | SEQ ID NO: 2050 CGTCAGATGTCCGAGTA GAGGGGGAACGGCGAAA GGACCTGGCGG |
| CU-1298 | 1888 ATCCCGGACGAGCC CCCA | 1975 | TGTCAGGCAACCGTATTCA CCGTGAGTGGTTGGGGG | SEQ ID NO: 2051 CGTCAGATGTCCGAGTA GAGGGGGAACGGCGATC CCGGACGAG |
| CU-1300 | 1889 TCCTCACACGGGGC ACCA | 1976 | TGTCAGGCAACCGTATTCA CCGTGAGTGGTTGGTGC | SEQ ID NO: 2052 CGTCAGATGTCCGAGTA GAGGGGGAACGGCGTCC TCACACGGG |
| CU-1303 | 1890 ATCCCACTTCTGAC ACCA | 1977 | TGTCAGGCAACCGTATTCA CCGTGAGTGGTTGGTGT | SEQ ID NO: 2053 CGTCAGATGTCCGAGTA GAGGGGGAACGGCGATC CCACTTCTG |

TABLE 14-continued

List of probes and primers used for Northern Blot and RT-PCR analyses, respectively.

| | | | | |
|---|---|---|---|---|
| CU-1307 | 1891 ACCCCACTATGCTT AGCCCT | 1978 | TGTCAGGCAACCGTATTCA CCGTGAGTGGTAGGGCT | SEQ ID NO: 2054 CGTCAGATGTCCGAGTA GAGGGGGAACGGCGACC CCACTATGCTT |
| CU-1323 | 1892 TGTATTGTGAGACA TTC | 1979 | TGTCAGGCAACCGTATTCA CCGTGAGTGGTGAATGT | SEQ ID NO: 2055 CGTCAGATGTCCGAGTA GAGGGGGAACGGCGTGT ATTGTGAG |
| CU-1324 | 1893 TCTCGGTGGAACCT CCA | 1980 | TGTCAGGCAACCGTATTCA CCGTGAGTGGTTGGAGG | SEQ ID NO: 2056 CGTCAGATGTCCGAGTA GAGGGGGAACGGCGTCT CGGTGGAA |
| CU-1339 | 1894 ATCCCCAGCACCTC CACCA | 1981 | TGTCAGGCAACCGTATTCA CCGTGAGTGGTTGGTGG | SEQ ID NO: 2057 CGTCAGATGTCCGAGTA GAGGGGGAACGGCGATC CCCAGCACCT |
| CU-1345 | 1895 AGAACACTACGAGC CACA | 1982 | TGTCAGGCAACCGTATTCA CCGTGAGTGGTTGTGGC | SEQ ID NO: 2058 CGTCAGATGTCCGAGTA GAGGGGGAACGGCGAGA ACACTACGA |
| CU-1352 | 1896 ACCCCACTTCTGGT ACCA | 1983 | TGTCAGGCAACCGTATTCA CCGTGAGTGGTTGGTACCA | SEQ ID NO: 2059 CGTCAGATGTCCGAGTA GAGGGGGAACGGCGACC CCACTTC |
| CU-1363 | 1897 CGTTCGCGCTTTCC CCTG | 1984 | TGTCAGGCAACCGTATTCA CCGTGAGTGGTCAGGGGAA AG | SEQ ID NO: 2060 CGTCAGATGTCCGAGTA GAGGGGGAACGGCGCGT TCGCG |
| CU-1368 | 1898 GACGAGGTGGCCGA GTGG | 1985 | TGTCAGGCAACCGTATTCA CCGTGAGTGGTCCACTC | SEQ ID NO: 2061 CGTCAGATGTCCGAGTA GAGGGGGAACGGCGGAC GAGGTGGCC |
| CU-1369 | 1899 TCCCCGGCATCTCC ACCA | 1986 | TGTCAGGCAACCGTATTCA CCGTGAGTGGTTGGTGG | SEQ ID NO: 2062 CGTCAGATGTCCGAGTA GAGGGGGAACGGCGTCC CCGGCATCT |
| CU-1370_MOD | 1900 CTGATTGCTCCTAT CTGATT | 1987 | TGTCAGGCAACCGTATTCA CCGTGAGTGGTAATCAG | SEQ ID NO: 2063 CGTCAGATGTCCGAGTA GAGGGGGAACGGCGCTG ATTGCTCCTAT |
| CU-1371 | 1901 TCTAGAGGAGCCTG TTCTGTA | 1988 | TGTCAGGCAACCGTATTCA CCGTGAGTGGTTACAGA | SEQ ID NO: 2064 CGTCAGATGTCCGAGTA GAGGGGGAACGGCGTCT AGAGGAGCCTGT |
| CU-1379 | 1902 TCGGGTGCGAGAGG TCCCGGGT | 1989 | TGTCAGGCAACCGTATTCA CCGTGAGTGGTACCCGGGA CC | SEQ ID NO: 2065 CGTCAGATGTCCGAGTA GAGGGGGAACGGCGTCG GGTGCGAGA |
| CU-1380 | 1903 ATAGGTTTGGTCCT AGCCTTTCT | 1990 | TGTCAGGCAACCGTATTCA CCGTGAGTGGTAGAAAG | SEQ ID NO: 2066 CGTCAGATGTCCGAGTA GAGGGGGAACGGCGATA GGTTTGGTCCTAGC |
| CU-1381 | 1904 TCGATTCCCGGTCA GGGAACCA | 1991 | TGTCAGGCAACCGTATTCA CCGTGAGTGGTTGGTTC | SEQ ID NO: 2067 CGTCAGATGTCCGAGTA GAGGGGGAACGGCGTCG ATTCCCGGTCAGG |
| CU-1382 | 1905 TCCTCGTTAGTATA GTGGTGAGTATCCC | 1992 | TGTCAGGCAACCGTATTCA CCGTGAGTGGTGGGATA | SEQ ID NO: 2068 CGTCAGATGTCCGAGTA GAGGGGGAACGGCGTCC TCGTTAGTATAGTGGT |
| CU-1388 | 1906 TCCCTGGTGGTCTA GTGGTTAGGATTCG | 1993 | TGTCAGGCAACCGTATTCA CCGTGAGTGGTCGAATC | SEQ ID NO: 2069 CGTCAGATGTCCGAGTA |

TABLE 14-continued

List of probes and primers used for Northern Blot and RT-PCR analyses, respectively.

| | | | | |
|---|---|---|---|---|
| | | | | GAGGGGGAACGGCGTCC CTGGTGGTCTAGTGGT |
| CU-1396 | 1907 TAAGTGTTTGTGGG TTA | 1994 | TGTCAGGCAACCGTATTCA CCGTGAGTGGTTAACCCAC A | SEQ ID NO: 2070 CGTCAGATGTCCGAGTA GAGGGGGAACGGCGTAA GTGTT |
| CU-1403 | 1908 GCATTGGTGGTTCA GTGGTAGA | 1995 | TGTCAGGCAACCGTATTCA CCGTGAGTGGTTCTACC | SEQ ID NO: 2071 CGTCAGATGTCCGAGTA GAGGGGGAACGGCGGCA TTGGTGGTTCAGT |
| CU-1440 | 1909 TGGTTATCACGTTC GCC | 1996 | TGTCAGGCAACCGTATTCA CCGTGAGTGGTGGCGAACG T | SEQ ID NO: 2072 CGTCAGATGTCCGAGTA GAGGGGGAACGGCGTGG TTATC |
| CU-1453 | 1910 CCCTGCTCGCTGCG CCA | 1997 | TGTCAGGCAACCGTATTCA CCGTGAGTGGTTGGCGC | SEQ ID NO: 2073 CGTCAGATGTCCGAGTA GAGGGGGAACGGCGCCC TGCTCGCT |
| CU-1457 | 1911 TTCTCACTACTGCA CTTGACTA | 1998 | TGTCAGGCAACCGTATTCA CCGTGAGTGGTTAGTCA | SEQ ID NO: 2074 CGTCAGATGTCCGAGTA GAGGGGGAACGGCGTTC TCACTACTGCACT |
| CU-1470 | 1912 CTCCTGGCTGGCTC GCCA | 1999 | TGTCAGGCAACCGTATTCA CCGTGAGTGGTTGGCGA | SEQ ID NO: 2075 CGTCAGATGTCCGAGTA GAGGGGGAACGGCGCTC CTGGCTGGC |
| CU-1477 | 1913 CTCCCACTGCTTCA CTTGACTAGC | 2000 | TGTCAGGCAACCGTATTCA CCGTGAGTGGTGCTAGT | SEQ ID NO: 2076 CGTCAGATGTCCGAGTA GAGGGGGAACGGCGCTC CCACTGCTTCACTTG |
| CU-1486 | 1914 CTGCTGTGATGACA TTC | 2001 | TGTCAGGCAACCGTATTCA CCGTGAGTGGTGAATGT | SEQ ID NO: 2077 CGTCAGATGTCCGAGTA GAGGGGGAACGGCGCTG CTGTGATG |
| CU-1488 | 1915 TCCTGCCGCGGTCG CCA | 2002 | TGTCAGGCAACCGTATTCA CCGTGAGTGGTTGGCGA | SEQ ID NO: 2078 CGTCAGATGTCCGAGTA GAGGGGGAACGGCGTCC TGCCGCGG |
| CU-1513 | 1916 GCGGGTGATGCGAA CTGGAGTCTGAGC | 2003 | TGTCAGGCAACCGTATTCA CCGTGAGTGGTGCTCAG | SEQ ID NO: 2079 CGTCAGATGTCCGAGTA GAGGGGGAACGGCGGCG GGTGATGCGAACTGGA |
| CU-1524 | 1917 CCCCCACAACCGCG CTTGACTAGC | 2004 | TGTCAGGCAACCGTATTCA CCGTGAGTGGTGCTAGT | SEQ ID NO: 2080 CGTCAGATGTCCGAGTA GAGGGGGAACGGCGCCC CCACAACCGCGCTTG |
| CU-1528 | 1918 TAGGGGTATGATTC TCGCT | 2005 | TGTCAGGCAACCGTATTCA CCGTGAGTGGTAGCGAG | SEQ ID NO: 2081 CGTCAGATGTCCGAGTA GAGGGGGAACGGCGTAG GGGTATGATT |
| CU-1538 | 1919 GGCTGGTCCGAGTG CAGTGGTGTTTA | 2006 | TGTCAGGCAACCGTATTCA CCGTGAGTGGTTAAACACC AC | SEQ ID NO: 2082 CGTCAGATGTCCGAGTA GAGGGGGAACGGCGGGC TGGTCCGAGTGCAGTG |
| CU-1542 | 1920 GGCTGGTCCGATGG TAGTGGGTT | 2007 | TGTCAGGCAACCGTATTCA CCGTGAGTGGTAACCCA | SEQ ID NO: 2083 CGTCAGATGTCCGAGTA GAGGGGGAACGGCGGGC TGGTCCGATGGTAG |
| CU-1545 | 1921 CCACGAGGAAGAGA GGTAGC | 2008 | TGTCAGGCAACCGTATTCA CCGTGAGTGGTGCTACCTC T | SEQ ID NO: 2084 CGTCAGATGTCCGAGTA GAGGGGGAACGGCGCCA CGAGGAAG |

TABLE 14-continued

List of probes and primers used for Northern Blot and RT-PCR analyses, respectively.

| | | | | |
|---|---|---|---|---|
| CU-1550 | 1922 CGGAAGCGTGCTGGGCCC | 2009 | TGTCAGGCAACCGTATTCACCGTGAGTGGTGGGCCC | SEQ ID NO: 2085 CGTCAGATGTCCGAGTAGAGGGGGAACGGCGCGGAAGCGTGCT |
| CU-1557 | 1923 GGAGAGAACGCGGTCTGAGTGGT | 2010 | TGTCAGGCAACCGTATTCACCGTGAGTGGTACCACT | SEQ ID NO: 2086 CGTCAGATGTCCGAGTAGAGGGGGAACGGCGGGAGAGAACGCGGTCTG |
| CU-1570 | 1924 ATCCCCAGCATCTCCACCA | 2011 | TGTCAGGCAACCGTATTCACCGTGAGTGGTTGGTGG | SEQ ID NO: 2087 CGTCAGATGTCCGAGTAGAGGGGGAACGGCGATCCCCAGCATCT |
| CU-1575 | 1925 CCCCCCACTGCTAAATTTGACTGGA | 2012 | TGTCAGGCAACCGTATTCACCGTGAGTGGTTCCAGT | SEQ ID NO: 2088 CGTCAGATGTCCGAGTAGAGGGGGAACGGCGCCCCCCACTGCTAAATTTG |

| Universal primer ID | Universal primer sequences (5'-3') |
|---|---|
| MPF | SEQ ID NO: 2089 TGTCAGGCAACCGTATTCACC |
| MPR | SEQ ID NO: 2090 CGTCAGATGTCCGAGTAGAGG |

| Control Primer ID | Control primer sequences (5'-3') |
|---|---|
| 5s_rRNA_FWD | SEQ ID NO: 2091 GCCCGATCTCGTCTGATCT |
| 5s_rRNA_REV | SEQ ID NO: 2092 AGCCTACAGCACCCGGTATT |

RNA Blot.

Total RNA and small RNA fractions were purified using the Trizol Reagent (Invitrogen) and the PureLink miRNA Isolation Kit (Invitrogen), respectively, following the manufacturer's indications. Electrophoresis was performed on 15% denaturing polyacrylamide gel and then RNA was transferred on Duralon UV membrane (Stratagene) using a semi-dry transfer apparatus. Pre-hybridization and hybridization were performed in 5×SSC, 20 mM $Na_2HPO_4$ pH7.2, 7% SDS, 3×Denhardt's Solution. Oligonucleotide probes were [$\gamma$-$^{32}$P]-ATP labeled by polynucleotide kinase (Fermentas). The list of oligonucleotides and their hybridization temperature is reported in Table S8. After over-night hybridization, membranes were washed at the same temperature in 3×SSC, 25 mM $NaH_2PO_4$ pH 7.5, 5% SDS, 10×Denhardt's Solution for 15-20' and in 1× SSC, 1% SDS for 5'. Images were obtained by exposure to phosphoimager cassette and acquisition by Storm 840 Phosphoimager (Molecular Dynamics) and by film exposure for approximately 2 weeks.

Estimation of Library Complexity.

A bootstrap technique was used to estimate the total number of miRNAs expressed in each library and the number of short-RNAs must be sequenced to achieve a complete coverage. Bootstrapping is a statistical technique for estimating properties of an "estimator" by measuring those properties in multiple subsets of the samples (Harrell, 2001; Hinkley, 1997). Specifically, we estimated the distribution of mature miRNAs obtained by random sub-sampling different size short-RNA libraries from each complete library. For each size $N=10, 20, \ldots N_t$, where $N_t$ is the total number of short-RNAs in the library, we randomly sampled 1000 libraries of size N and computed the number r(N) of inferred miRNAs, resulting in a distribution p(r(N)) for which we could compute standard statistical parameters such as average, variance, mode and median. Based on this sampling, we can extrapolate p(r(N)) for increasing values of N to determine at which point it is no longer efficient to use larger values of N to increase miRNA coverage. To achieve this, we fitted the data to the parametric function $f(x)=K*(1-e^{-mx})$.

Since we include both experimentally confirmed and putative mature miRNAs and since bootstrapping can produce optimistic results we expect that the estimated values constitute an upper boundary on the real library complexity. Based on this analysis, we estimated that the total numbers of mature miRNAs are: 129 (naïve), 154 (memory), 204 (centroblasts) and 189 (Ramos). Thus, the libraries sequenced in this study cover respectively 90.7% (naïve), 88.3% (memory), 85.8% (centroblasts), and 91% (Ramos) of the expressed miRNAs in these cellular phenotypes. FIG. 23 gives the 95% confidence intervals for p(r(N)) at each sampling point, in addition to the curve of the associated extrapolated function for each library. Clearly, the bootstrap analysis estimate of the total number of miRNA is correct only if the abundance of the miRNAs expressed in the sampled populations closely matches that of known miRNA in miRBase. This is not unreasonable if, as done here, only miRNAs that are specific to a B cell differentiation stage or transformation are considered. Thus, this does not estimate the total number of miRNA expressed across all human cell types, stages of differentiation and neoplastic transformations, which could be several fold larger than what was estimated from the B cell libraries.

Orthology and Conservation Analysis.

We investigated conservation of known and predicted precursor and mature human miRNA in chimp (panTro2), monkey (rheMac2), dog (canFam2) mouse (mm8) and rat (rn4). We obtained 678 miRNA precursor sequences from miRBase (v.11.0), 666 mature miRNAs and 167 star sequences. In total, we obtained 947 locations for mature and star mirBase sequences. We predicted 388 precursors of which 114 match miRBase precursors and 274 are newly predicted. Categorizing these by their corresponding mature sequences, 255 precursors correspond to mature miRNAs that are not included in the miRBase and 133 precursors are associated with 103 predicted miRNAs that match miRBase miRNAs. Of the 274 newly predicted precursors, 19 associated with 8 mature sequences listed in miRBase database.

miRNA conservation has been repeatedly used to help identify putative miRNA mappings to genomes. To identify putative ortholog miRNAs we relied on UCSC-provided Blastz pairwise alignments between human and target species (Schwartz et al., 2003). We used two related but complementary methods: (1) map the mature human miRNA to its ortholog location as specified by pairwise alignment; and (2) map the precursor of the human miRNA to its ortholog location as specified by pairwise alignment, expanding the human region to include at least 80 bases from both sides of the mature region, and identifying regions in the target that match the sequence of the mature human miRNA.

Method 1 is the simplest but fails to account for alignment inaccuracies and local mutations that may shift the position of the mature sequence in the target species. Method 2 accounts for locally imperfect Blastz mapping, but relies on conservation of larger regions that may not be subject to the same selective pressure as the mature miRNA. Alignment-based mapping of the human mature miRNA to its target were required to have either perfect conservation of the entire mature miRNA sequence or conservation of seeds composed of seven bases starting from the second position of the human mature sequence followed by conservation of 3 bases starting from the 12th, 13th or 14th position as suggested by (Grimson et al., 2007) (Appendix Table 11). We scanned the entire mapped ortholog region for a match to the human mature sequence or to its seed.

miRNA Target Prediction and Analysis.

Target predictions for not previously reported miRNAs were performed by miRanda v1.0 (John et al., 2004) and RNA22 (Miranda et al., 2006) using recommended parameters with the exception of RNA22 energy threshold that was changed from default −25.0 kcal/mol to −20.0 kcal/mol.

In order to investigate the potential effect of miRNAs on the transcriptome, predicted targets were tested for enrichment in genes down-regulated in the same population over-expressing the tested miRNA. Over-expressed miRNA were selected based on a minimum frequency value >0.08 and a three-fold increase in their cloning frequency comparing CB vs naïve or memory B cell libraries. Genes differentially expressed across normal B cell populations were identified based on intensity fold change greater than 1.5, and p-value under 0.01 according to a non-parametric U test applied to six biological replicates per cell type (gene expression data are available from GEO database; GSE2350).

For each miRNA, using a Fisher exact test, we compared the numbers of down- and up-regulated predicted targets to down- and up-regulated genes that are not predicted targets. Setting a p-value threshold of 0.01, targets of most GC-specific miRNAs were significantly down regulated in CB. Conversely, targets of naïve- and memory-specific miRNAs were not significantly differentially regulated. Therefore the analysis was focused on targets of the 15 GC-specific miRNAs. Predicted targets of 8 out of 15 miRNAs showed significant enrichment (p-value <0.001) in genes down-regulated in GC compared to naïve B cells and 2 of them showed enrichment for genes down-regulated in a control population (memory compared to naïve) (Table 13). We can conclude that targets of GC-specific miRNAs are significantly more likely to be down regulated in CB than in naïve B cells with p<0.05 according to a Fisher exact test. Moreover, down-regulation p-values in CB were systematically lower than in memory (FIG. 26 and Table 13). Of the target sets for the 15 GC-specific miRNAs, 11 were more significantly down regulated in CB, 2 were more significantly down regulated in the control population (memory), and 2 were not down regulated in either (FIG. 26). Using down-regulation in memory as control, we therefore conclude that down-regulation p-values are lower for CB with p<0.05 according to a binomial test with an 11/15 rate under a null hypothesis of equally likely odds for greater down regulation. In summary, while targets of naïve and memory specific miRNAs were not found differentially expressed in our data, we were able to demonstrate that predicted targets of GC-specific miRNAs are enriched in genes that are down regulated in GC.

Correlation Between Cloning and Microarray miRNA Profiling.

In order to compare cloning and microarray data, we focused on the 89 miRNAs for which both types of data were available. A significant correlation (p-value ≤3.9e-28) was shown between cloning and miRNA microarray data as measured by Spearman correlation. The corresponding scatter plot is shown in FIG. 27. Furthermore, to investigate if miRNA cloning counts were predictive of differential expression as measured by miRNA microarray, we identified 39 miRNAs whose cloning frequency was at least 2 fold greater in one normal B cell subset relative to each of the remaining two subsets. Of these, 25 (64.1%) miRNAs were found to be over-expressed in the same B cell subset according to miRNA microarray profiling. Over-expression was measured using a one sided U test, with threshold corresponding to p<0.01. We used permutation testing to estimate the significance of the success rate, randomly shuffling expression labels while keeping clone frequencies unchanged. The distribution of confirmed clone predictions using the shuffled expression data had mean of 1.2% and standard deviation of 5.1%, corresponding to 12.2 standard deviations away from our prediction success rate and a p-value near zero. We conclude that miRNA cloning counts are predictive of miRNAs concentration levels and differential expression.

Immunoprecipitation.

Immunoprecipitations were performed from Ramos cells grown in IMDM, 10% fetal bovine serum, 1% Penicillin/Streptomycin. 1-2×10^8 cells were collected and resuspended in 1 ml lysis buffer (10 mM Tris pH 7.5, 2 mM $MgCl_2$, 10 mM KCl, 2.5 mM DTT, 1× protease inhibitors, 40 U/ul Ambion Superase-IN). Lysate supernatant was mixed with 500 ul ATP depletion mix (450 mM KCl, 100 mM glucose, 0.5 U/ul Sigma-Aldrich hexokinase). Cleared supernatant was divided equally between paramagnetic protein G beads (New England Biolabs) bound to either a monoclonal rat antibody raised against human Ago2 protein (Rudel et al., 2008) or total purified rat IgG (Sigma-Aldrich). Beads were incubated with lysate under rotation for 2 hours at 4° C., then washed three times with ice-cold lysis buffer and collected in Trizol (Invitrogen) for RNA extraction. RNA from three sequential immunoprecipitations was pooled and $\frac{1}{10}^{th}$ of yield was used for reverse transcription of each miRNA species using Superscript III First Strand Synthesis Kit (Invitrogen), in the presence of 0.2 µM RTFS primer (miRNA-specific primers, see Table S8). cDNA was also generated from reverse transcription in the presence of random hexamers to test expression of 5s rRNA. $\frac{1}{10}^{th}$ of the cDNA volume was used as template for SYBR (Applied Biosystems) qPCR amplification in the presence of 4 nM SS primer (miRNA-specific primers, see Table 14) and 0.4 µM each of MPF and MPR universal or 0.4 µM each of 5sRNA primers (Table 14). Each qPCR reaction was performed in triplicate. The tested miRNA were selected based on the availability of optimized qRT-PCR conditions among the ones detectable both by RNA blot and RT-PCR.

Accession Numbers.

The miRNA array profiles data are available from the GEO repository (GSE15144).

REFERENCES

Bartel, D. P. (2004). MicroRNAs: genomics, biogenesis, mechanism, and function. Cell 116, 281-297.

Basso, K., Margolin, A. A., Stolovitzky, G., Klein, U., Dalla-Favera, R., and Califano, A. (2005). Reverse engineering of regulatory networks in human B cells. Nat Genet. 37, 382-390.

Bentwich, I., et al. (2005). Identification of hundreds of conserved and nonconserved human microRNAs. Nat Genet. 37, 766-770.

Calabrese, J. M., Seila, A. C., Yeo, G. W., and Sharp, P. A. (2007). RNA sequence analysis defines Dicer's role in mouse embryonic stem cells. Proc Natl Acad Sci USA 104, 18097-18102.

Calin, G. A., et al. (2002). Frequent deletions and down-regulation of micro-RNA genes miR15 and miR16 at 13q14 in chronic lymphocytic leukemia. Proc Natl Acad Sci USA 99, 15524-15529.

Calin, G. A., Ferracin, M., Cimmino, A., Di Leva, G., Shimizu, M., Wojcik, S. E., Iorio, M. V., Visone, R., Sever, N. I., Fabbri, M., et al. (2005). A MicroRNA signature associated with prognosis and progression in chronic lymphocytic leukemia. N Engl J Med 353, 1793-1801.

Chen, C. Z., Li, L., Lodish, H. F., and Bartel, D. P. (2004). MicroRNAs modulate hematopoietic lineage differentiation. Science 303, 83-86.

Cummins, J. M., He, Y., Leary, R. J., Pagliarini, R., Diaz, L. A., Jr., Sjoblom, T., Barad, O., Bentwich, Z., Szafranska, A. E., Labourier, E., et al. (2006). The colorectal microRNAome. Proc Natl Acad Sci USA 103, 3687-3692.

Dorsett, Y., et al. (2008). MicroRNA-155 suppresses activation-induced cytidine deaminase-mediated Myc-Igh translocation. Immunity 28, 630-638.

Eisen, M. B., Spellman, P. T., Brown, P. O., and Botstein, D. (1998). Cluster analysis and display of genome-wide expression patterns. Proc Natl Acad Sci USA 95, 14863-14868.

Filipowicz, W., Bhattacharyya, S. N., and Sonenberg, N. (2008). Mechanisms of post-transcriptional regulation by microRNAs: are the answers in sight? Nat Rev Genet. 9, 102-114.

Griffiths-Jones, S. (2006). miRBase: the microRNA sequence database. Methods Mol Biol 342, 129-138.

Griffiths-Jones, S., Grocock, R. J., van Dongen, S., Bateman, A., and Enright, A. J. (2006). miRBase: microRNA sequences, targets and gene nomenclature. Nucleic Acids Res 34, D140-144.

Grimson, A., Farh, K. K., Johnston, W. K., Garrett-Engele, P., Lim, L. P., and Bartel, D. P. (2007). MicroRNA targeting specificity in mammals: determinants beyond seed pairing. Mol Cell 27, 91-105.

Harrell, F. E. (2001). Regression modeling strategies: with applications to linear models, logistic regression, and survival analysis (N.Y., Springer).

Hartigan, J. A. (1975). Clustering Algorithms (New York, Wiley).

He, L., et al., (2005). A microRNA polycistron as a potential human oncogene. Nature 435, 828-833.

Hinkley, A. C. D. a. D. V. (1997). Bootstrap Methods and their Applications (New York, Cambridge University Press).

John, B., Enright, A. J., Aravin, A., Tuschl, T., Sander, C., and Marks, D. S. (2004). Human MicroRNA targets. PLoS Biol 2, e363.

Kawahara, Y., Zinshteyn, B., Sethupathy, P., Iizasa, H., Hatzigeorgiou, A. G., and Nishikura, K. (2007). Redirection of silencing targets by adenosine-to-inosine editing of miRNAs. Science 315, 1137-1140.

Kim, V. N. (2005). MicroRNA biogenesis: coordinated cropping and dicing. Nat Rev Mol Cell Biol 6, 376-385.

Klein, U., and Dalla-Favera, R. (2008). Germinal centres: role in B-cell physiology and malignancy. Nat Rev Immunol 8, 22-33.

Klein, U., Tu, Y., Stolovitzky, G. A., Keller, J. L., Haddad, J., Jr., Miljkovic, V., Cattoretti, G., Califano, A., and Dalla-Favera, R. (2003). Transcriptional analysis of the B cell germinal center reaction. Proc Natl Acad Sci USA 100, 2639-2644.

Kuppers, R., and Dalla-Favera, R. (2001). Mechanisms of chromosomal translocations in B cell lymphomas. Oncogene 20, 5580-5594.

Landgraf, P., Rusu, M., Sheridan, R., Sewer, A., Iovino, N., Aravin, A., Pfeffer, S., Rice, A., Kamphorst, A. O., Landthaler, M., et al. (2007). A mammalian microRNA expression atlas based on small RNA library sequencing. Cell 129, 1401-1414.

Lau, N. C., Lim, L. P., Weinstein, E. G., and Bartel, D. P. (2001). An abundant class of tiny RNAs with probable regulatory roles in *Caenorhabditis elegans*. Science 294, 858-862.

Lee, E. J., Baek, M., Gusev, Y., Brackett, D. J., Nuovo, G. J., and Schmittgen, T. D. (2007). Systematic evaluation of microRNA processing patterns in tissues, cell lines, and tumors. Rna 14, 35-42.

Li, Q. J., Chau, J., Ebert, P. J., Sylvester, G., Min, H., Liu, G., Braich, R., Manoharan, M., Soutschek, J., Skare, P., et al. (2007). miR-181a is an intrinsic modulator of T cell sensitivity and selection. Cell 129, 147-161.

Lu, J., et al. (2005). MicroRNA expression profiles classify human cancers. Nature 435, 834-838.

Luciano, D. J., Mirsky, H., Vendetti, N. J., and Maas, S. (2004). RNA editing of a miRNA precursor. Rna 10, 1174-1177.

Michael, M. Z., SM, O. C., van Holst Pellekaan, N. G., Young, G. P., and James, R. J. (2003). Reduced accumulation of specific microRNAs in colorectal neoplasia. Mol Cancer Res 1, 882-891.

Miranda, K. C., Huynh, T., Tay, Y., Ang, Y. S., Tam, W. L., Thomson, A. M., Lim, B., and Rigoutsos, I. (2006). A pattern-based method for the identification of MicroRNA binding sites and their corresponding heteroduplexes. Cell 126, 1203-1217.

Mourelatos, Z., Dostie, J., Paushkin, S., Sharma, A., Charroux, B., Abel, L., Rappsilber, J., Mann, M., and Dreyfuss, G. (2002). miRNPs: a novel class of ribonucleoproteins containing numerous microRNAs. Genes Dev 16, 720-728.

Neilson, J. R., Zheng, G. X., Burge, C. B., and Sharp, P. A. (2007). Dynamic regulation of miRNA expression in ordered stages of cellular development. Genes Dev 21, 578-589.

Rodriguez, A., Vigorito, E., Clare, S., Warren, M. V., Couttet, P., Soond, D. R., van Dongen, S., Grocock, R. J., Das, P. P., Miska, E. A., et al. (2007). Requirement of bic/microRNA-155 for normal immune function. Science 316, 608-611.

Schwartz, S., Kent, W. J., Smit, A., Zhang, Z., Baertsch, R., Hardison, R. C., Haussler, D., and Miller, W. (2003). Human-mouse alignments with BLASTZ. Genome Res 13, 103-107.

Sharbati-Telurani, S., Kutz-Lohroff, B., Bergbauer, R., Scholven, J., and Einspanier, R. (2008). miR-Q: a novel quantitative RT-PCR approach for the expression profiling of small RNA molecules such as miRNAs in a complex sample. BMC Mol Biol 9, 34.

Teng, G., et al. (2008). MicroRNA-155 is a negative regulator of activation-induced cytidine deaminase. Immunity 28, 621-629.

Thai, T. H., et al. (2007). Regulation of the germinal center response by microRNA-155. Science 316, 604-608.

Thomson, J. M., Newman, M., Parker, J. S., Morin-Kensicki, E. M., Wright, T., and Hammond, S. M. (2006). Extensive post-transcriptional regulation of microRNAs and its implications for cancer. Genes Dev 20, 2202-2207.

Xiao, C., Calado, D. P., Gaiter, G., That, T. H., Patterson, H. C., Wang, J., Rajewsky, N., Bender, T. P., and Rajewsky, K. (2007). MiR-150 Controls B Cell Differentiation by Targeting the Transcription Factor c-Myb. Cell 131, 146-159

Griffiths-Jones, S. (2006). miRBase: the microRNA sequence database. Methods Mol Biol 342, 129-138.

Griffiths-Jones, S., Grocock, R. J., van Dongen, S., Bateman, A., and Enright, A. J. (2006). miRBase: microRNA sequences, targets and gene nomenclature. Nucleic Acids Res 34, D140-144.

Grimson, A., Farh, K. K., Johnston, W. K., Garrett-Engele, P., Lim, L. P., and Bartel, D. P. (2007). MicroRNA targeting specificity in mammals: determinants beyond seed pairing. Mol Cell 27, 91-105.

Harrell, F. E. (2001). Regression modeling strategies: with applications to linear models, logistic regression, and survival analysis (N.Y., Springer).

Hinkley, A. C. D. a. D. V. (1997). Bootstrap Methods and their Applications (New York, Cambridge University Press).

John, B., Enright, A. J., Aravin, A., Tuschl, T., Sander, C., and Marks, D. S. (2004). Human MicroRNA targets. PLoS Biol 2, e363.

Landgraf, P., Rusu, M., Sheridan, R., Sewer, A., Iovino, N., Aravin, A., Pfeffer, S., Rice, A., Kamphorst, A. O., Landthaler, M., et al. (2007). A mammalian microRNA expression atlas based on small RNA library sequencing. Cell 129, 1401-1414.

Miranda, K. C., Huynh, T., Tay, Y., Ang, Y. S., Tam, W. L., Thomson, A. M., Lim, B., and Rigoutsos, I. (2006). A pattern-based method for the identification of MicroRNA binding sites and their corresponding heteroduplexes. Cell 126, 1203-1217.

Rudel, S., Flatley, A., Weinmann, L, Kremmer, E., and Meister, G. (2008). A multifunctional human Argonaute2-specific monoclonal antibody. Rna 14, 1244-1253.

Schwartz, S., Kent, W. J., Smit, A., Zhang, Z., Baertsch, R., Hardison, R. C., Haussler, D., and Miller, W. (2003). Human-mouse alignments with BLASTZ. Genome Res 13, 103-107.

SEQUENCE LISTING (4762 sequences)

SEQ ID NO: 1 - DNA, 23 bp, Artificial Sequence
  Description of Artificial Sequence: Synthetic oligonucleotide
tgtagtgtttcctactttatgga

SEQ ID NO: 2 - DNA, 22 bp, Artificial Sequence
  Description of Artificial Sequence: Synthetic oligonucleotide
tagcttatcagactgatgttga

SEQ ID NO: 3 - DNA, 23 bp, Artificial Sequence
  Description of Artificial Sequence: Synthetic oligonucleotide
taaagtgcttatagtgcaggtag

SEQ ID NO: 4 - DNA, 22 bp, Artificial Sequence
  Description of Artificial Sequence: Synthetic oligonucleotide
tagcagcacatcatggtttaca

SEQ ID NO: 5 - DNA, 22 bp, Artificial Sequence
  Description of Artificial Sequence: Synthetic oligonucleotide
tagcagcacgtaaatattggcg

SEQ ID NO: 6 - DNA, 22 bp, Artificial Sequence
  Description of Artificial Sequence: Synthetic oligonucleotide
tgaggtagtaggttgtatagtt

SEQ ID NO: 7 - DNA, 22 bp, Artificial Sequence
  Description of Artificial Sequence: Synthetic oligonucleotide
tattgcacttgtcccggcctgt

SEQ ID NO: 8 - DNA, 17 bp, Artificial Sequence
  Description of Artificial Sequence: Synthetic oligonucleotide
tcccaccgctgccacca

SEQ ID NO: 9 - DNA, 22 bp, Artificial Sequence
  Description of Artificial Sequence: Synthetic oligonucleotide
tgaggtagtagattgtatagtt

SEQ ID NO: 10 - DNA, 22 bp, Artificial Sequence
  Description of Artificial Sequence: Synthetic oligonucleotide
tagcaccatctgaaatcggtta

SEQ ID NO: 11 - DNA, 21 bp, Artificial Sequence
  Description of Artificial Sequence: Synthetic oligonucleotide
tagcagcacataatggtttgt

SEQ ID NO: 12 - DNA, 21 bp, Artificial Sequence
  Description of Artificial Sequence: Synthetic oligonucleotide
cccataaagtagaaagcacta

SEQ ID NO: 13 - DNA, 22 bp, Artificial Sequence
  Description of Artificial Sequence: Synthetic oligonucleotide
tgaggtagtagtttgtacagtt

SEQ ID NO: 14 - DNA, 22 bp, Artificial Sequence
  Description of Artificial Sequence: Synthetic oligonucleotide
tgaggtagtagtttgtgctgtt

SEQ ID NO: 15 - DNA, 22 bp, Artificial Sequence
  Description of Artificial Sequence: Synthetic oligonucleotide
tagcaccatttgaaatcggtta

SEQ ID NO: 16 - DNA, 23 bp, Artificial Sequence
  Description of Artificial Sequence: Synthetic oligonucleotide
tgtaaacatcctacactctcagc

SEQ ID NO: 17 - DNA, 23 bp, Artificial Sequence
  Description of Artificial Sequence: Synthetic oligonucleotide
caaagtgcttacagtgcaggtag

SEQ ID NO: 18 - DNA, 22 bp, Artificial Sequence
  Description of Artificial Sequence: Synthetic oligonucleotide
cattgcacttgtctcggtctga

SEQ ID NO: 19 - DNA, 23 bp, Artificial Sequence
  Description of Artificial Sequence: Synthetic oligonucleotide
caacggaatcccaaaagcagctg

SEQ ID NO: 20 - DNA, 23 bp, Artificial Sequence
  Description of Artificial Sequence: Synthetic oligonucleotide
tgtgcaaatccatgcaaaactga

SEQ ID NO: 21 - DNA, 22 bp, Artificial Sequence
  Description of Artificial Sequence: Synthetic oligonucleotide
taccacagggtagaaccacgga

SEQ ID NO: 22 - DNA, 22 bp, Artificial Sequence
  Description of Artificial Sequence: Synthetic oligonucleotide
tgtaaacatcctacactcagct

SEQ ID NO: 23 - DNA, 22 bp, Artificial Sequence
  Description of Artificial Sequence: Synthetic oligonucleotide
tgaggtagtaggttgtgtggtt

SEQ ID NO: 24 - DNA, 23 bp, Artificial Sequence
  Description of Artificial Sequence: Synthetic oligonucleotide
tagcaccatttgaaatcagtgtt

SEQ ID NO: 25 - DNA, 21 bp, Artificial Sequence
  Description of Artificial Sequence: Synthetic oligonucleotide
taaagtgctgacagtgcagat

SEQ ID NO: 26 - DNA, 20 bp, Artificial Sequence
  Description of Artificial Sequence: Synthetic oligonucleotide
tccctgtcctccaggagctc

SEQ ID NO: 27 - DNA, 22 bp, Artificial Sequence
  Description of Artificial Sequence: Synthetic oligonucleotide
ttcaagtaatccaggataggct

SEQ ID NO: 28 - DNA, 23 bp, Artificial Sequence
  Description of Artificial Sequence: Synthetic oligonucleotide
caaagtgctgttcgtgcaggtag

SEQ ID NO: 29 - DNA, 22 bp, Artificial Sequence
  Description of Artificial Sequence: Synthetic oligonucleotide
tgtcagtttgtcaaatacccca

SEQ ID NO: 30 - DNA, 22 bp, Artificial Sequence
  Description of Artificial Sequence: Synthetic oligonucleotide
tgagaactgaattccatgggtt

SEQ ID NO: 31 - DNA, 21 bp, Artificial Sequence
  Description of Artificial Sequence: Synthetic oligonucleotide
tctcccaacccttgtaccagt

SEQ ID NO: 32 - DNA, 22 bp, Artificial Sequence
  Description of Artificial Sequence: Synthetic oligonucleotide
tccctgagaccctaacttgtga

SEQ ID NO: 33 - DNA, 24 bp, Artificial Sequence
  Description of Artificial Sequence: Synthetic oligonucleotide
tctcacacagaaatcgcacccgtc

SEQ ID NO: 34 - DNA, 18 bp, Artificial Sequence
  Description of Artificial Sequence: Synthetic oligonucleotide
gtccctgttcgggcgcca

SEQ ID NO: 35 - DNA, 23 bp, Artificial Sequence
  Description of Artificial Sequence: Synthetic oligonucleotide
tgtgcaaatctatgcaaaactga

SEQ ID NO: 36 - DNA, 22 bp, Artificial Sequence
  Description of Artificial Sequence: Synthetic oligonucleotide
tgtaaacatccccgactggaag

SEQ ID NO: 37 - DNA, 21 bp, Artificial Sequence
  Description of Artificial Sequence: Synthetic oligonucleotide
agctacattgtctgctgggtt

SEQ ID NO: 38 - DNA, 22 bp, Artificial Sequence
  Description of Artificial Sequence: Synthetic oligonucleotide
agaggtagtaggttgcatagtt

SEQ ID NO: 39 - DNA, 20 bp, Artificial Sequence
  Description of Artificial Sequence: Synthetic oligonucleotide
ccgcactgtgggtacttgct

SEQ ID NO: 40 - DNA, 23 bp, Artificial Sequence
  Description of Artificial Sequence: Synthetic oligonucleotide
agcagcattgtacagggctatga

SEQ ID NO: 41 - DNA, 22 bp, Artificial Sequence
  Description of Artificial Sequence: Synthetic oligonucleotide
aactggccctcaaagtcccgct

SEQ ID NO: 42 - DNA, 21 bp, Artificial Sequence
  Description of Artificial Sequence: Synthetic oligonucleotide
gcccctgggcctatcctagaa

SEQ ID NO: 43 - DNA, 24 bp, Artificial Sequence
  Description of Artificial Sequence: Synthetic oligonucleotide
agctggtgttgtgaatcaggccgt

SEQ ID NO: 44 - DNA, 22 bp, Artificial Sequence
  Description of Artificial Sequence: Synthetic oligonucleotide
tgaggggcagagagcgagactt

SEQ ID NO: 45 - DNA, 23 bp, Artificial Sequence
  Description of Artificial Sequence: Synthetic oligonucleotide
agctacatctggctactgggtct

SEQ ID NO: 46 - DNA, 17 bp, Artificial Sequence
  Description of Artificial Sequence: Synthetic oligonucleotide
gtgggggagaggctgta

SEQ ID NO: 47 - DNA, 21 bp, Artificial Sequence
  Description of Artificial Sequence: Synthetic oligonucleotide
ctatacgacctgctgcctttc

SEQ ID NO: 48 - DNA, 23 bp, Artificial Sequence
  Description of Artificial Sequence: Synthetic oligonucleotide
ttaatgctaatcgtgataggggt

SEQ ID NO: 49 - DNA, 20 bp, Artificial Sequence
  Description of Artificial Sequence: Synthetic oligonucleotide
agggggaaagttctatagtc

SEQ ID NO: 50 - DNA, 21 bp, Artificial Sequence
  Description of Artificial Sequence: Synthetic oligonucleotide
acagtagtctgcacattggtt

SEQ ID NO: 51 - DNA, 24 bp, Artificial Sequence
  Description of Artificial Sequence: Synthetic oligonucleotide
aacattcaacgctgtcggtgagtt

SEQ ID NO: 52 - DNA, 23 bp, Artificial Sequence
  Description of Artificial Sequence: Synthetic oligonucleotide
tggaagactagtgattttgttgt

SEQ ID NO: 53 - DNA, 22 bp, Artificial Sequence
  Description of Artificial Sequence: Synthetic oligonucleotide
taatgcccctaaaaatccttat

SEQ ID NO: 54 - DNA, 22 bp, Artificial Sequence
  Description of Artificial Sequence: Synthetic oligonucleotide
tagcagcacagaaatattggca

SEQ ID NO: 55 - DNA, 18 bp, Artificial Sequence
  Description of Artificial Sequence: Synthetic oligonucleotide
tgaggtagtaggttgtat

SEQ ID NO: 56 - DNA, 22 bp, Artificial Sequence
  Description of Artificial Sequence: Synthetic oligonucleotide
tcctgtactgagctgccccgag

SEQ ID NO: 57 - DNA, 24 bp, Artificial Sequence
  Description of Artificial Sequence: Synthetic oligonucleotide
tccctgagaccctttaacctgtga

SEQ ID NO: 58 - DNA, 22 bp, Artificial Sequence
  Description of Artificial Sequence: Synthetic oligonucleotide
atcacattgccagggatttcca

SEQ ID NO: 59 - DNA, 21 bp, Artificial Sequence
  Description of Artificial Sequence: Synthetic oligonucleotide
tcacagtgaaccggtctcttt

SEQ ID NO: 60 - DNA, 22 bp, Artificial Sequence
  Description of Artificial Sequence: Synthetic oligonucleotide
cactagattgtgagctcctgga

SEQ ID NO: 61 - DNA, 21 bp, Artificial Sequence
  Description of Artificial Sequence: Synthetic oligonucleotide
caacaaatcacagtctgccat

SEQ ID NO: 62 - DNA, 23 bp, Artificial Sequence
  Description of Artificial Sequence: Synthetic oligonucleotide
caaagtgcttatagtgcaggtag

SEQ ID NO: 63 - DNA, 23 bp, Artificial Sequence
  Description of Artificial Sequence: Synthetic oligonucleotide
aggttgggatcggttgcaatgct

SEQ ID NO: 64 - DNA, 23 bp, Artificial Sequence
  Description of Artificial Sequence: Synthetic oligonucleotide
acattcattgctgtcggtgggtt

SEQ ID NO: 65 - DNA, 22 bp, Artificial Sequence
  Description of Artificial Sequence: Synthetic oligonucleotide
tcccccaggtgtgattctgatt

SEQ ID NO: 66 - DNA, 23 bp, Artificial Sequence
  Description of Artificial Sequence: Synthetic oligonucleotide
cccagtgttcagactacctgttc

SEQ ID NO: 67 - DNA, 21 bp, Artificial Sequence
  Description of Artificial Sequence: Synthetic oligonucleotide
accaatattactgtgctgctt

SEQ ID NO: 68 - DNA, 24 bp, Artificial Sequence
  Description of Artificial Sequence: Synthetic oligonucleotide
tgtaaacatccttgactggaagct

SEQ ID NO: 69 - DNA, 22 bp, Artificial Sequence
  Description of Artificial Sequence: Synthetic oligonucleotide
taaggtgcatctagtgcagata

SEQ ID NO: 70 - DNA, 22 bp, Artificial Sequence
  Description of Artificial Sequence: Synthetic oligonucleotide
atcacattgccagggattacca

SEQ ID NO: 71 - DNA, 22 bp, Artificial Sequence
  Description of Artificial Sequence: Synthetic oligonucleotide
actgccctaagtgctccttctg

SEQ ID NO: 72 - DNA, 20 bp, Artificial Sequence
  Description of Artificial Sequence: Synthetic oligonucleotide
tgtaaacatcctcgactgga

SEQ ID NO: 73 - DNA, 22 bp, Artificial Sequence
  Description of Artificial Sequence: Synthetic oligonucleotide
tacagtactgtgataactgaag

SEQ ID NO: 74 - DNA, 21 bp, Artificial Sequence
  Description of Artificial Sequence: Synthetic oligonucleotide
ctagactgaagctccttgagg

SEQ ID NO: 75 - DNA, 23 bp, Artificial Sequence
  Description of Artificial Sequence: Synthetic oligonucleotide
tggcagtgtcttagctggttgtt

SEQ ID NO: 76 - DNA, 22 bp, Artificial Sequence
  Description of Artificial Sequence: Synthetic oligonucleotide
tgaggtagtaagttgtattgtt

SEQ ID NO: 77 - DNA, 24 bp, Artificial Sequence
  Description of Artificial Sequence: Synthetic oligonucleotide
tgagaactgaattccataggctgt

SEQ ID NO: 78 - DNA, 22 bp, Artificial Sequence
  Description of Artificial Sequence: Synthetic oligonucleotide
tcgaggagctcacagtctagta

SEQ ID NO: 79 - DNA, 22 bp, Artificial Sequence
  Description of Artificial Sequence: Synthetic oligonucleotide
agctcggtctgaggcccctcag

SEQ ID NO: 80 - DNA, 22 bp, Artificial Sequence
  Description of Artificial Sequence: Synthetic oligonucleotide
actgcagtgaaggcacttgtag

SEQ ID NO: 81 - DNA, 20 bp, Artificial Sequence
  Description of Artificial Sequence: Synthetic oligonucleotide
accatcgaccgttgattgta

SEQ ID NO: 82 - DNA, 21 bp, Artificial Sequence
  Description of Artificial Sequence: Synthetic oligonucleotide
ttcaccaccttctccacccag

SEQ ID NO: 83 - DNA, 20 bp, Artificial Sequence
  Description of Artificial Sequence: Synthetic oligonucleotide
ttcacagtggctaagttctg

SEQ ID NO: 84 - DNA, 22 bp, Artificial Sequence
  Description of Artificial Sequence: Synthetic oligonucleotide
ttcaagtaattcaggataggtt

SEQ ID NO: 85 - DNA, 21 bp, Artificial Sequence
  Description of Artificial Sequence: Synthetic oligonucleotide
tgggtttacgttgggagaact

SEQ ID NO: 86 - DNA, 16 bp, Artificial Sequence
  Description of Artificial Sequence: Synthetic oligonucleotide
tgggttgagagggcga

SEQ ID NO: 87 - DNA, 22 bp, Artificial Sequence
  Description of Artificial Sequence: Synthetic oligonucleotide
tgaggtaggaggttgtatagtt

SEQ ID NO: 88 - DNA, 21 bp, Artificial Sequence
  Description of Artificial Sequence: Synthetic oligonucleotide
tgaccgatttctcctggtgtt

SEQ ID NO: 89 - DNA, 19 bp, Artificial Sequence
  Description of Artificial Sequence: Synthetic oligonucleotide
tattgcactcgtcccggcc

SEQ ID NO: 90 - DNA, 20 bp, Artificial Sequence
  Description of Artificial Sequence: Synthetic oligonucleotide
ggggtgctatctgtgattga

SEQ ID NO: 91 - DNA, 23 bp, Artificial Sequence
  Description of Artificial Sequence: Synthetic oligonucleotide
gcatgggtggttcagtggtagaa

SEQ ID NO: 92 - DNA, 18 bp, Artificial Sequence
  Description of Artificial Sequence: Synthetic oligonucleotide
ctggccctctctgccctt

SEQ ID NO: 93 - DNA, 20 bp, Artificial Sequence
  Description of Artificial Sequence: Synthetic oligonucleotide
ctgacctatgaattgacagc

SEQ ID NO: 94 - DNA, 21 bp, Artificial Sequence
  Description of Artificial Sequence: Synthetic oligonucleotide
ctcctgactccaggtcctgtg

SEQ ID NO: 95 - DNA, 18 bp, Artificial Sequence
  Description of Artificial Sequence: Synthetic oligonucleotide
cgtcaacacttgctggtt

SEQ ID NO: 96 - DNA, 21 bp, Artificial Sequence
  Description of Artificial Sequence: Synthetic oligonucleotide
cgaatcattatttgctgctct

SEQ ID NO: 97 - DNA, 22 bp, Artificial Sequence
  Description of Artificial Sequence: Synthetic oligonucleotide
catcgggaatgtcgtgtccgcc

SEQ ID NO: 98 - DNA, 21 bp, Artificial Sequence
  Description of Artificial Sequence: Synthetic oligonucleotide
cagtggttttaccctatggta

SEQ ID NO: 99 - DNA, 22 bp, Artificial Sequence
  Description of Artificial Sequence: Synthetic oligonucleotide
cagtgcaatgatgaaagggcat

SEQ ID NO: 100 - DNA, 21 bp, Artificial Sequence
  Description of Artificial Sequence: Synthetic oligonucleotide
cagcagcacactgtggtttgt

SEQ ID NO: 101 - DNA, 21 bp, Artificial Sequence
  Description of Artificial Sequence: Synthetic oligonucleotide
cacgctcatgcacacacccac

SEQ ID NO: 102 - DNA, 22 bp, Artificial Sequence
  Description of Artificial Sequence: Synthetic oligonucleotide
aaggagctcacagtctattgag

SEQ ID NO: 103 - DNA, 22 bp, Artificial Sequence
  Description of Artificial Sequence: Synthetic oligonucleotide
ttggtccccttcaaccagctgt

SEQ ID NO: 104 - DNA, 21 bp, Artificial Sequence
  Description of Artificial Sequence: Synthetic oligonucleotide
ttcacagtggctaagttccga

SEQ ID NO: 105 - DNA, 22 bp, Artificial Sequence
  Description of Artificial Sequence: Synthetic oligonucleotide
ttatcagaatctccaggggtaa

SEQ ID NO: 106 - DNA, 23 bp, Artificial Sequence
  Description of Artificial Sequence: Synthetic oligonucleotide
tggagagaaaggcagttcctgat

SEQ ID NO: 107 - DNA, 22 bp, Artificial Sequence
  Description of Artificial Sequence: Synthetic oligonucleotide
tgagacctctgggttctgagct

SEQ ID NO: 108 - DNA, 23 bp, Artificial Sequence
  Description of Artificial Sequence: Synthetic oligonucleotide
tctttggttatctagctgtatga

SEQ ID NO: 109 - DNA, 21 bp, Artificial Sequence
  Description of Artificial Sequence: Synthetic oligonucleotide
tctagtaagagtggcagtcga

SEQ ID NO: 110 - DNA, 21 bp, Artificial Sequence
  Description of Artificial Sequence: Synthetic oligonucleotide
tattgcacattactaagttga

SEQ ID NO: 111 - DNA, 21 bp, Artificial Sequence
  Description of Artificial Sequence: Synthetic oligonucleotide
taaggcacgcggtgaatgcca

SEQ ID NO: 112 - DNA, 23 bp, Artificial Sequence
  Description of Artificial Sequence: Synthetic oligonucleotide
taacactgtctggtaacgatgtt

SEQ ID NO: 113 - DNA, 22 bp, Artificial Sequence
  Description of Artificial Sequence: Synthetic oligonucleotide
gtgaaatgtttaggaccactag

SEQ ID NO: 114 - DNA, 22 bp, Artificial Sequence
  Description of Artificial Sequence: Synthetic oligonucleotide
gcagtccatgggcatatacaca

SEQ ID NO: 115 - DNA, 22 bp, Artificial Sequence
  Description of Artificial Sequence: Synthetic oligonucleotide
gagcttattcataaaagtgcag

SEQ ID NO: 116 - DNA, 22 bp, Artificial Sequence
  Description of Artificial Sequence: Synthetic oligonucleotide
ctgccctggcccgagggaccga

SEQ ID NO: 117 - DNA, 20 bp, Artificial Sequence
  Description of Artificial Sequence: Synthetic oligonucleotide
ctatacaacctactgccttc

SEQ ID NO: 118 - DNA, 22 bp, Artificial Sequence
  Description of Artificial Sequence: Synthetic oligonucleotide
cggggttttgagggcgagatga

SEQ ID NO: 119 - DNA, 22 bp, Artificial Sequence
  Description of Artificial Sequence: Synthetic oligonucleotide
ccagtggggctgctgttatctg

SEQ ID NO: 120 - DNA, 22 bp, Artificial Sequence
  Description of Artificial Sequence: Synthetic oligonucleotide
ccagtattaactgtgctgctga

SEQ ID NO: 121 - DNA, 22 bp, Artificial Sequence
  Description of Artificial Sequence: Synthetic oligonucleotide
cacccgtagaaccgaccttgcg

SEQ ID NO: 122 - DNA, 22 bp, Artificial Sequence
  Description of Artificial Sequence: Synthetic oligonucleotide
caagctcgtgtctgtgggtccg

SEQ ID NO: 123 - DNA, 22 bp, Artificial Sequence
  Description of Artificial Sequence: Synthetic oligonucleotide
caacaccagtcgatgggctgta

SEQ ID NO: 124 - DNA, 20 bp, Artificial Sequence
  Description of Artificial Sequence: Synthetic oligonucleotide
aggcggagacttgggcaatt

SEQ ID NO: 125 - DNA, 23 bp, Artificial Sequence
  Description of Artificial Sequence: Synthetic oligonucleotide
actgcattatgagcacttaaagt

SEQ ID NO: 126 - DNA, 21 bp, Artificial Sequence
  Description of Artificial Sequence: Synthetic oligonucleotide
actgatttcttttggtgttca

SEQ ID NO: 127 - DNA, 23 bp, Artificial Sequence
  Description of Artificial Sequence: Synthetic oligonucleotide
actcggcgtggcgtcggtcgtgg

SEQ ID NO: 128 - DNA, 21 bp, Artificial Sequence
  Description of Artificial Sequence: Synthetic oligonucleotide
accactgaccgttgactgtac

SEQ ID NO: 129 - DNA, 22 bp, Artificial Sequence
  Description of Artificial Sequence: Synthetic oligonucleotide
aactggcctacaaagtcccagt

SEQ ID NO: 130 - DNA, 15 bp, Artificial Sequence
  Description of Artificial Sequence: Synthetic oligonucleotide
tgtctgagcgtcgct

SEQ ID NO: 131 - DNA, 20 bp, Artificial Sequence
  Description of Artificial Sequence: Synthetic oligonucleotide
gccgggtactttcgtatttt

SEQ ID NO: 132 - DNA, 26 bp, Artificial Sequence
  Description of Artificial Sequence: Synthetic oligonucleotide
gctaaggaagtcctgtgctcagtttt

SEQ ID NO: 133 - DNA, 17 bp, Artificial Sequence
  Description of Artificial Sequence: Synthetic oligonucleotide
cccgggtttcggcacca

SEQ ID NO: 134 - DNA, 21 bp, Artificial Sequence
  Description of Artificial Sequence: Synthetic oligonucleotide
tcgggcgggagtggtggcttt

SEQ ID NO: 135 - DNA, 19 bp, Artificial Sequence
  Description of Artificial Sequence: Synthetic oligonucleotide
tagaggcaccgcctgccca

SEQ ID NO: 136 - DNA, 18 bp, Artificial Sequence
  Description of Artificial Sequence: Synthetic oligonucleotide
cggggcgcggcctcgctg

SEQ ID NO: 137 - DNA, 22 bp, Artificial Sequence
  Description of Artificial Sequence: Synthetic oligonucleotide
cccacgggggtctccgggcgag

SEQ ID NO: 138 - DNA, 16 bp, Artificial Sequence
  Description of Artificial Sequence: Synthetic oligonucleotide
cccacgggaaacagca

SEQ ID NO: 139 - DNA, 22 bp, Artificial Sequence
  Description of Artificial Sequence: Synthetic oligonucleotide
cagcccggcctggctcctccat

SEQ ID NO: 140 - DNA, 17 bp, Artificial Sequence
  Description of Artificial Sequence: Synthetic oligonucleotide
cacggaaggtggcccgg

SEQ ID NO: 141 - DNA, 16 bp, Artificial Sequence
  Description of Artificial Sequence: Synthetic oligonucleotide
ctgtaggcacctgaaa

SEQ ID NO: 142 - DNA, 27 bp, Artificial Sequence
  Description of Artificial Sequence: Synthetic oligonucleotide
ccccccactgctaaatttgactggctt

SEQ ID NO: 143 - DNA, 17 bp, Artificial Sequence
  Description of Artificial Sequence: Synthetic oligonucleotide
gcccgcatcctccacca

SEQ ID NO: 144 - DNA, 16 bp, Artificial Sequence
  Description of Artificial Sequence: Synthetic oligonucleotide
cccggccaacgcacca

SEQ ID NO: 145 - DNA, 18 bp, Artificial Sequence
  Description of Artificial Sequence: Synthetic oligonucleotide
atcccactcctgacacca

SEQ ID NO: 146 - DNA, 16 bp, Artificial Sequence
  Description of Artificial Sequence: Synthetic oligonucleotide
ccgggcggaaacacca

SEQ ID NO: 147 - DNA, 17 bp, Artificial Sequence
  Description of Artificial Sequence: Synthetic oligonucleotide
tgtcagtttgttaatta

SEQ ID NO: 148 - DNA, 17 bp, Artificial Sequence
  Description of Artificial Sequence: Synthetic oligonucleotide
agggtgtgcgtgttttt

SEQ ID NO: 149 - DNA, 22 bp, Artificial Sequence
  Description of Artificial Sequence: Synthetic oligonucleotide
tcgattcccggcccatgcacca

SEQ ID NO: 150 - DNA, 17 bp, Artificial Sequence
  Description of Artificial Sequence: Synthetic oligonucleotide
gagagcgctcggttttt

SEQ ID NO: 151 - DNA, 19 bp, Artificial Sequence
  Description of Artificial Sequence: Synthetic oligonucleotide
tggtgtggtctgttgtttt

SEQ ID NO: 152 - DNA, 23 bp, Artificial Sequence
  Description of Artificial Sequence: Synthetic oligonucleotide
tgtgctccggagttacctcgttt

SEQ ID NO: 153 - DNA, 18 bp, Artificial Sequence
  Description of Artificial Sequence: Synthetic oligonucleotide
tccccgacacctccacca

SEQ ID NO: 154 - DNA, 17 bp, Artificial Sequence
  Description of Artificial Sequence: Synthetic oligonucleotide
ctgtaggcatcatcaat

SEQ ID NO: 155 - DNA, 28 bp, Artificial Sequence
  Description of Artificial Sequence: Synthetic oligonucleotide
aaccgagcgtccaagctctttccatttt

SEQ ID NO: 156 - DNA, 17 bp, Artificial Sequence
  Description of Artificial Sequence: Synthetic oligonucleotide
tccccgcacctccacca

SEQ ID NO: 157 - DNA, 18 bp, Artificial Sequence
  Description of Artificial Sequence: Synthetic oligonucleotide
tccccggcacttccacca

SEQ ID NO: 158 - DNA, 17 bp, Artificial Sequence
  Description of Artificial Sequence: Synthetic oligonucleotide
tcaccccataaacacca

SEQ ID NO: 159 - DNA, 18 bp, Artificial Sequence
  Description of Artificial Sequence: Synthetic oligonucleotide
ctgtaggcaccatcataa

SEQ ID NO: 160 - DNA, 16 bp, Artificial Sequence
  Description of Artificial Sequence: Synthetic oligonucleotide
cccaccagagtcgcca

SEQ ID NO: 161 - DNA, 18 bp, Artificial Sequence
  Description of Artificial Sequence: Synthetic oligonucleotide
ttccccgacggggagcca

SEQ ID NO: 162 - DNA, 19 bp, Artificial Sequence
  Description of Artificial Sequence: Synthetic oligonucleotide
ggcgtgattcatacctttt

SEQ ID NO: 163 - DNA, 15 bp, Artificial Sequence
  Description of Artificial Sequence: Synthetic oligonucleotide
gcgggcggacctttt

SEQ ID NO: 164 - DNA, 15 bp, Artificial Sequence
  Description of Artificial Sequence: Synthetic oligonucleotide
cggctcgaaggacca

SEQ ID NO: 165 - DNA, 15 bp, Artificial Sequence
  Description of Artificial Sequence: Synthetic oligonucleotide
ccccggccccgcgta

SEQ ID NO: 166 - DNA, 16 bp, Artificial Sequence
  Description of Artificial Sequence: Synthetic oligonucleotide
cccacctctgacacca

SEQ ID NO: 167 - DNA, 16 bp, Artificial Sequence
  Description of Artificial Sequence: Synthetic oligonucleotide
ccacgaggtcggccgg

SEQ ID NO: 168 - DNA, 15 bp, Artificial Sequence
  Description of Artificial Sequence: Synthetic oligonucleotide
caggatcggcccact

SEQ ID NO: 169 - DNA, 18 bp, Artificial Sequence
  Description of Artificial Sequence: Synthetic oligonucleotide
atgtggtggcttactttt

SEQ ID NO: 170 - DNA, 16 bp, Artificial Sequence
  Description of Artificial Sequence: Synthetic oligonucleotide
atcccggacgagccca

SEQ ID NO: 171 - DNA, 19 bp, Artificial Sequence
  Description of Artificial Sequence: Synthetic oligonucleotide
atccccagcatctccacca

SEQ ID NO: 172 - DNA, 17 bp, Artificial Sequence
  Description of Artificial Sequence: Synthetic oligonucleotide
agaaaggccgaatttta

SEQ ID NO: 173 - DNA, 17 bp, Artificial Sequence
  Description of Artificial Sequence: Synthetic oligonucleotide
tgtcagtttttacccaa

SEQ ID NO: 174 - DNA, 17 bp, Artificial Sequence
  Description of Artificial Sequence: Synthetic oligonucleotide
tgtcagtttgaacccaa

SEQ ID NO: 175 - DNA, 19 bp, Artificial Sequence
  Description of Artificial Sequence: Synthetic oligonucleotide
tgtagtgtttcttacttta

SEQ ID NO: 176 - DNA, 18 bp, Artificial Sequence
  Description of Artificial Sequence: Synthetic oligonucleotide
tggcgaaggtcggccgcg

SEQ ID NO: 177 - DNA, 19 bp, Artificial Sequence
  Description of Artificial Sequence: Synthetic oligonucleotide
tgcagggccggcggggagg

SEQ ID NO: 178 - DNA, 15 bp, Artificial Sequence
  Description of Artificial Sequence: Synthetic oligonucleotide
tcgggcggcgggcgt

SEQ ID NO: 179 - DNA, 28 bp, Artificial Sequence
  Description of Artificial Sequence: Synthetic oligonucleotide
tcggctttccctgctaactgggcttttt

SEQ ID NO: 180 - DNA, 20 bp, Artificial Sequence
  Description of Artificial Sequence: Synthetic oligonucleotide
tcagagcgcgggccgacccc

SEQ ID NO: 181 - DNA, 17 bp, Artificial Sequence
  Description of Artificial Sequence: Synthetic oligonucleotide
tcaacacccactccctc

SEQ ID NO: 182 - DNA, 20 bp, Artificial Sequence
  Description of Artificial Sequence: Synthetic oligonucleotide
tatcaatgatgcttctgaga

SEQ ID NO: 183 - DNA, 18 bp, Artificial Sequence
  Description of Artificial Sequence: Synthetic oligonucleotide
taaccccagggttggtca

SEQ ID NO: 184 - DNA, 15 bp, Artificial Sequence
  Description of Artificial Sequence: Synthetic oligonucleotide
ggggtccccggtaga

SEQ ID NO: 185 - DNA, 20 bp, Artificial Sequence
  Description of Artificial Sequence: Synthetic oligonucleotide
gggcgtgggtgtgatgattc

SEQ ID NO: 186 - DNA, 18 bp, Artificial Sequence
  Description of Artificial Sequence: Synthetic oligonucleotide
gggaggtgagtaggtctg

SEQ ID NO: 187 - DNA, 17 bp, Artificial Sequence
  Description of Artificial Sequence: Synthetic oligonucleotide
ggagacgtggccgagag

SEQ ID NO: 188 - DNA, 17 bp, Artificial Sequence
  Description of Artificial Sequence: Synthetic oligonucleotide
gcggaataccacgggga

SEQ ID NO: 189 - DNA, 19 bp, Artificial Sequence
  Description of Artificial Sequence: Synthetic oligonucleotide
gcaggcgggggattagcta

SEQ ID NO: 190 - DNA, 20 bp, Artificial Sequence
  Description of Artificial Sequence: Synthetic oligonucleotide
gcagcggaacgtcggcgcgc

SEQ ID NO: 191 - DNA, 16 bp, Artificial Sequence
  Description of Artificial Sequence: Synthetic oligonucleotide
gacgtcaccctcctca

SEQ ID NO: 192 - DNA, 19 bp, Artificial Sequence
  Description of Artificial Sequence: Synthetic oligonucleotide
cttggactaacctggtgta

SEQ ID NO: 193 - DNA, 17 bp, Artificial Sequence
  Description of Artificial Sequence: Synthetic oligonucleotide
ctgtaggccaccatcca

SEQ ID NO: 194 - DNA, 15 bp, Artificial Sequence
  Description of Artificial Sequence: Synthetic oligonucleotide
ctgtaggcaccacca

SEQ ID NO: 195 - DNA, 17 bp, Artificial Sequence
  Description of Artificial Sequence: Synthetic oligonucleotide
ctggtaggcacctgaaa

SEQ ID NO: 196 - DNA, 24 bp, Artificial Sequence
  Description of Artificial Sequence: Synthetic oligonucleotide
ctgatgttgatgcatatgatgaca

SEQ ID NO: 197 - DNA, 21 bp, Artificial Sequence
  Description of Artificial Sequence: Synthetic oligonucleotide
cggtggaacctgcattggttt

SEQ ID NO: 198 - DNA, 18 bp, Artificial Sequence
  Description of Artificial Sequence: Synthetic oligonucleotide
cggggccggggctagggt

SEQ ID NO: 199 - DNA, 20 bp, Artificial Sequence
  Description of Artificial Sequence: Synthetic oligonucleotide
cgggccgcccccgcccaccg

SEQ ID NO: 200 - DNA, 16 bp, Artificial Sequence
  Description of Artificial Sequence: Synthetic oligonucleotide
cgggccccggggctcg

SEQ ID NO: 201 - DNA, 20 bp, Artificial Sequence
  Description of Artificial Sequence: Synthetic oligonucleotide
cggcctatccggaatgcccc

SEQ ID NO: 202 - DNA, 16 bp, Artificial Sequence
  Description of Artificial Sequence: Synthetic oligonucleotide
cggacctccctggccc

SEQ ID NO: 203 - DNA, 21 bp, Artificial Sequence
  Description of Artificial Sequence: Synthetic oligonucleotide
cgcggccagtgtccccttgta

SEQ ID NO: 204 - DNA, 20 bp, Artificial Sequence
  Description of Artificial Sequence: Synthetic oligonucleotide
cgacacacggcccgtggcgc

SEQ ID NO: 205 - DNA, 15 bp, Artificial Sequence
  Description of Artificial Sequence: Synthetic oligonucleotide
cctcataaataccgg

SEQ ID NO: 206 - DNA, 17 bp, Artificial Sequence
  Description of Artificial Sequence: Synthetic oligonucleotide
cctcactgggggctcca

SEQ ID NO: 207 - DNA, 17 bp, Artificial Sequence
  Description of Artificial Sequence: Synthetic oligonucleotide
cctcacctggagcacca

SEQ ID NO: 208 - DNA, 15 bp, Artificial Sequence
  Description of Artificial Sequence: Synthetic oligonucleotide
ccgtactggccacca

SEQ ID NO: 209 - DNA, 15 bp, Artificial Sequence
  Description of Artificial Sequence: Synthetic oligonucleotide
ccgccgcccccccct

SEQ ID NO: 210 - DNA, 18 bp, Artificial Sequence
  Description of Artificial Sequence: Synthetic oligonucleotide
ccgccccgaccttagcta

SEQ ID NO: 211 - DNA, 16 bp, Artificial Sequence
  Description of Artificial Sequence: Synthetic oligonucleotide
cccgtccgctgcgcca

SEQ ID NO: 212 - DNA, 16 bp, Artificial Sequence
  Description of Artificial Sequence: Synthetic oligonucleotide
cccgtccactccgcca

SEQ ID NO: 213 - DNA, 17 bp, Artificial Sequence
  Description of Artificial Sequence: Synthetic oligonucleotide
ccccggcccatgcacca

SEQ ID NO: 214 - DNA, 17 bp, Artificial Sequence
  Description of Artificial Sequence: Synthetic oligonucleotide
ccccggcatctccatca

SEQ ID NO: 215 - DNA, 17 bp, Artificial Sequence
  Description of Artificial Sequence: Synthetic oligonucleotide
ccccagtacctccacca

SEQ ID NO: 216 - DNA, 16 bp, Artificial Sequence
  Description of Artificial Sequence: Synthetic oligonucleotide
cccagcggtgcctcca

SEQ ID NO: 217 - DNA, 16 bp, Artificial Sequence
  Description of Artificial Sequence: Synthetic oligonucleotide
ccacgctctgctacca

SEQ ID NO: 218 - DNA, 18 bp, Artificial Sequence
  Description of Artificial Sequence: Synthetic oligonucleotide
ccaccctggagcctccgt

SEQ ID NO: 219 - DNA, 17 bp, Artificial Sequence
  Description of Artificial Sequence: Synthetic oligonucleotide
atggtaggcacctgaaa

SEQ ID NO: 220 - DNA, 16 bp, Artificial Sequence
  Description of Artificial Sequence: Synthetic oligonucleotide
atgggcggtcctcgtt

SEQ ID NO: 221 - DNA, 20 bp, Artificial Sequence
  Description of Artificial Sequence: Synthetic oligonucleotide
atggcctggaccccactcct

SEQ ID NO: 222 - DNA, 17 bp, Artificial Sequence
  Description of Artificial Sequence: Synthetic oligonucleotide
atggccgcatatatttt

SEQ ID NO: 223 - DNA, 18 bp, Artificial Sequence
  Description of Artificial Sequence: Synthetic oligonucleotide
atcctgttcgtgacgcca

SEQ ID NO: 224 - DNA, 18 bp, Artificial Sequence
  Description of Artificial Sequence: Synthetic oligonucleotide
atcctgctcacagcccca

SEQ ID NO: 225 - DNA, 19 bp, Artificial Sequence
  Description of Artificial Sequence: Synthetic oligonucleotide
agcgagggttccgccggcc

SEQ ID NO: 226 - DNA, 26 bp, Artificial Sequence
  Description of Artificial Sequence: Synthetic oligonucleotide
actggggagggggaggagcctcgagg

SEQ ID NO: 227 - DNA, 18 bp, Artificial Sequence
  Description of Artificial Sequence: Synthetic oligonucleotide
accccgaggggacgggcg

SEQ ID NO: 228 - DNA, 18 bp, Artificial Sequence
  Description of Artificial Sequence: Synthetic oligonucleotide
acagcgctgtgttcccgt

SEQ ID NO: 229 - DNA, 22 bp, Artificial Sequence
  Description of Artificial Sequence: Synthetic oligonucleotide
acaaaaaaaaaagcccaaccct

SEQ ID NO: 230 - DNA, 18 bp, Artificial Sequence
  Description of Artificial Sequence: Synthetic oligonucleotide
aactaaaacccctacgca

SEQ ID NO: 231 - DNA, 17 bp, Artificial Sequence
  Description of Artificial Sequence: Synthetic oligonucleotide
aaaggagccgaatcttt

SEQ ID NO: 232 - DNA, 17 bp, Artificial Sequence
  Description of Artificial Sequence: Synthetic oligonucleotide
cccacccagggacgcca

SEQ ID NO: 233 - DNA, 18 bp, Artificial Sequence
  Description of Artificial Sequence: Synthetic oligonucleotide
tccccggcacctccacca

SEQ ID NO: 234 - DNA, 18 bp, Artificial Sequence
  Description of Artificial Sequence: Synthetic oligonucleotide
atcccggacgagccccca

SEQ ID NO: 235 - DNA, 16 bp, Artificial Sequence
  Description of Artificial Sequence: Synthetic oligonucleotide
cccacgttgggcgcca

SEQ ID NO: 236 - DNA, 22 bp, Artificial Sequence
  Description of Artificial Sequence: Synthetic oligonucleotide
tcgattcccggccaatgcacca

SEQ ID NO: 237 - DNA, 18 bp, Artificial Sequence
  Description of Artificial Sequence: Synthetic oligonucleotide
atcccacttctgacacca

SEQ ID NO: 238 - DNA, 16 bp, Artificial Sequence
  Description of Artificial Sequence: Synthetic oligonucleotide
tcgtaggcacctgaaa

SEQ ID NO: 239 - DNA, 18 bp, Artificial Sequence
  Description of Artificial Sequence: Synthetic oligonucleotide
tccccgtacgggccacca

SEQ ID NO: 240 - DNA, 16 bp, Artificial Sequence
  Description of Artificial Sequence: Synthetic oligonucleotide
ttgaccgctctgacca

SEQ ID NO: 241 - DNA, 16 bp, Artificial Sequence
  Description of Artificial Sequence: Synthetic oligonucleotide
cccagcggggcctcca

SEQ ID NO: 242 - DNA, 16 bp, Artificial Sequence
  Description of Artificial Sequence: Synthetic oligonucleotide
caggaacggtgcacca

SEQ ID NO: 243 - DNA, 19 bp, Artificial Sequence
  Description of Artificial Sequence: Synthetic oligonucleotide
agtcccatctgggtcgcca

SEQ ID NO: 244 - DNA, 25 bp, Artificial Sequence
  Description of Artificial Sequence: Synthetic oligonucleotide
ccccccactgctaaatttgactgga

SEQ ID NO: 245 - DNA, 18 bp, Artificial Sequence
  Description of Artificial Sequence: Synthetic oligonucleotide
gtttgttaattaacccaa

SEQ ID NO: 246 - DNA, 18 bp, Artificial Sequence
  Description of Artificial Sequence: Synthetic oligonucleotide
gtcccttcgtggtcgcca

SEQ ID NO: 247 - DNA, 15 bp, Artificial Sequence
  Description of Artificial Sequence: Synthetic oligonucleotide
ctgtagcacctgaaa

SEQ ID NO: 248 - DNA, 18 bp, Artificial Sequence
  Description of Artificial Sequence: Synthetic oligonucleotide
tcctcacacggggcacca

SEQ ID NO: 249 - DNA, 17 bp, Artificial Sequence
  Description of Artificial Sequence: Synthetic oligonucleotide
taacggccgcggtaccc

SEQ ID NO: 250 - DNA, 18 bp, Artificial Sequence
  Description of Artificial Sequence: Synthetic oligonucleotide
gagggggaccaaaaaaaa

SEQ ID NO: 251 - DNA, 16 bp, Artificial Sequence
  Description of Artificial Sequence: Synthetic oligonucleotide
cccgcattctccacca

SEQ ID NO: 252 - DNA, 17 bp, Artificial Sequence
  Description of Artificial Sequence: Synthetic oligonucleotide
aggggggtaaaaaaaaa

SEQ ID NO: 253 - DNA, 16 bp, Artificial Sequence
  Description of Artificial Sequence: Synthetic oligonucleotide
tccaccgctgccacca

SEQ ID NO: 254 - DNA, 23 bp, Artificial Sequence
  Description of Artificial Sequence: Synthetic oligonucleotide
gagccatgatgataccactgagc

SEQ ID NO: 255 - DNA, 19 bp, Artificial Sequence
  Description of Artificial Sequence: Synthetic oligonucleotide
cgtccatgatgttccgcaa

SEQ ID NO: 256 - DNA, 15 bp, Artificial Sequence
  Description of Artificial Sequence: Synthetic oligonucleotide
catcctctgctacca

SEQ ID NO: 257 - DNA, 18 bp, Artificial Sequence
  Description of Artificial Sequence: Synthetic oligonucleotide
agaacactacgagccaca

SEQ ID NO: 258 - DNA, 18 bp, Artificial Sequence
  Description of Artificial Sequence: Synthetic oligonucleotide
accccacttctggtacca

SEQ ID NO: 259 - DNA, 17 bp, Artificial Sequence
  Description of Artificial Sequence: Synthetic oligonucleotide
tgtattgtgagacattc

SEQ ID NO: 260 - DNA, 17 bp, Artificial Sequence
  Description of Artificial Sequence: Synthetic oligonucleotide
tctcggtggaacctcca

SEQ ID NO: 261 - DNA, 16 bp, Artificial Sequence
  Description of Artificial Sequence: Synthetic oligonucleotide
tccccggcacctccaa

SEQ ID NO: 262 - DNA, 19 bp, Artificial Sequence
  Description of Artificial Sequence: Synthetic oligonucleotide
taccgagcctggtgatagc

SEQ ID NO: 263 - DNA, 23 bp, Artificial Sequence
  Description of Artificial Sequence: Synthetic oligonucleotide
gcagcgccagcctcccgccctac

SEQ ID NO: 264 - DNA, 15 bp, Artificial Sequence
  Description of Artificial Sequence: Synthetic oligonucleotide
ccgcctggggagtac

SEQ ID NO: 265 - DNA, 19 bp, Artificial Sequence
  Description of Artificial Sequence: Synthetic oligonucleotide
atccccagcacctccacca

SEQ ID NO: 266 - DNA, 27 bp, Artificial Sequence
  Description of Artificial Sequence: Synthetic oligonucleotide
agcagtgatgtcctgaaaattctgaag

SEQ ID NO: 267 - DNA, 20 bp, Artificial Sequence
  Description of Artificial Sequence: Synthetic oligonucleotide
accccactatgcttagccct

SEQ ID NO: 268 - DNA, 20 bp, Artificial Sequence
  Description of Artificial Sequence: Synthetic oligonucleotide
aaaggacctggcggtgcttc

SEQ ID NO: 269 - DNA, 21 bp, Artificial Sequence
  Description of Artificial Sequence: Synthetic oligonucleotide
tttgccacactgcaacacctt

SEQ ID NO: 270 - DNA, 21 bp, Artificial Sequence
  Description of Artificial Sequence: Synthetic oligonucleotide
ttccttggatgtctgagtgac

SEQ ID NO: 271 - DNA, 26 bp, Artificial Sequence
  Description of Artificial Sequence: Synthetic oligonucleotide
ttaaaccaccaagatcgctgatgcac

SEQ ID NO: 272 - DNA, 17 bp, Artificial Sequence
  Description of Artificial Sequence: Synthetic oligonucleotide
tgttcgccgaccgttga

SEQ ID NO: 273 - DNA, 16 bp, Artificial Sequence
  Description of Artificial Sequence: Synthetic oligonucleotide
tggggtctgggaggga

SEQ ID NO: 274 - DNA, 19 bp, Artificial Sequence
  Description of Artificial Sequence: Synthetic oligonucleotide
tgggagagcagggtattgt

SEQ ID NO: 275 - DNA, 18 bp, Artificial Sequence
  Description of Artificial Sequence: Synthetic oligonucleotide
tgcagatgatgtaaaaga

SEQ ID NO: 276 - DNA, 24 bp, Artificial Sequence
  Description of Artificial Sequence: Synthetic oligonucleotide
tcgctatgatgatggattccaaaa

SEQ ID NO: 277 - DNA, 21 bp, Artificial Sequence
  Description of Artificial Sequence: Synthetic oligonucleotide
tccgaaaggcctcccgcaccg

SEQ ID NO: 278 - DNA, 16 bp, Artificial Sequence
  Description of Artificial Sequence: Synthetic oligonucleotide
tcccgcacctccacca

SEQ ID NO: 279 - DNA, 19 bp, Artificial Sequence
  Description of Artificial Sequence: Synthetic oligonucleotide
tagatgaataggtaaagag

SEQ ID NO: 280 - DNA, 28 bp, Artificial Sequence
  Description of Artificial Sequence: Synthetic oligonucleotide
gtgtatgatgacctcatgtagcctgaac

SEQ ID NO: 281 - DNA, 20 bp, Artificial Sequence
  Description of Artificial Sequence: Synthetic oligonucleotide
gtgaagcgttccatattttt

SEQ ID NO: 282 - DNA, 16 bp, Artificial Sequence
  Description of Artificial Sequence: Synthetic oligonucleotide
gggggggggtttggaa

SEQ ID NO: 283 - DNA, 17 bp, Artificial Sequence
  Description of Artificial Sequence: Synthetic oligonucleotide
ggggggagggaaggcaa

SEQ ID NO: 284 - DNA, 17 bp, Artificial Sequence
  Description of Artificial Sequence: Synthetic oligonucleotide
gggggctgggctgggta

SEQ ID NO: 285 - DNA, 17 bp, Artificial Sequence
  Description of Artificial Sequence: Synthetic oligonucleotide
ggggccgccgcctgtgt

SEQ ID NO: 286 - DNA, 17 bp, Artificial Sequence
  Description of Artificial Sequence: Synthetic oligonucleotide
gggagtccgcggcgagc

SEQ ID NO: 287 - DNA, 15 bp, Artificial Sequence
  Description of Artificial Sequence: Synthetic oligonucleotide
gggacctggggacca

SEQ ID NO: 288 - DNA, 17 bp, Artificial Sequence
  Description of Artificial Sequence: Synthetic oligonucleotide
ggcttggtctaggggta

SEQ ID NO: 289 - DNA, 18 bp, Artificial Sequence
  Description of Artificial Sequence: Synthetic oligonucleotide
ggctgggaccctggacac

SEQ ID NO: 290 - DNA, 18 bp, Artificial Sequence
  Description of Artificial Sequence: Synthetic oligonucleotide
ggcgacctgcgactcctt

SEQ ID NO: 291 - DNA, 16 bp, Artificial Sequence
  Description of Artificial Sequence: Synthetic oligonucleotide
ggaggggggaaacaaa

SEQ ID NO: 292 - DNA, 19 bp, Artificial Sequence
  Description of Artificial Sequence: Synthetic oligonucleotide
ggaggggggaaaaaaaaaa

SEQ ID NO: 293 - DNA, 20 bp, Artificial Sequence
  Description of Artificial Sequence: Synthetic oligonucleotide
ggaagacctgcaccactgtc

SEQ ID NO: 294 - DNA, 15 bp, Artificial Sequence
  Description of Artificial Sequence: Synthetic oligonucleotide
gcgggtgtcaggcct

SEQ ID NO: 295 - DNA, 18 bp, Artificial Sequence
  Description of Artificial Sequence: Synthetic oligonucleotide
gccgggcgtggtggtctg

SEQ ID NO: 296 - DNA, 21 bp, Artificial Sequence
  Description of Artificial Sequence: Synthetic oligonucleotide
gccgccgagaccccaggaccc

SEQ ID NO: 297 - DNA, 15 bp, Artificial Sequence
  Description of Artificial Sequence: Synthetic oligonucleotide
gcagccgtgctttta

SEQ ID NO: 298 - DNA, 20 bp, Artificial Sequence
  Description of Artificial Sequence: Synthetic oligonucleotide
gcaaatgatgccctctgatc

SEQ ID NO: 299 - DNA, 17 bp, Artificial Sequence
  Description of Artificial Sequence: Synthetic oligonucleotide
gaggggggtcaaaaaaa

SEQ ID NO: 300 - DNA, 24 bp, Artificial Sequence
  Description of Artificial Sequence: Synthetic oligonucleotide
cttgatgatgagcaggatctgagt

SEQ ID NO: 301 - DNA, 15 bp, Artificial Sequence
  Description of Artificial Sequence: Synthetic oligonucleotide
ctgtaggcactgaaa

SEQ ID NO: 302 - DNA, 16 bp, Artificial Sequence
  Description of Artificial Sequence: Synthetic oligonucleotide
ctgtaggcaccattaa

SEQ ID NO: 303 - DNA, 19 bp, Artificial Sequence
  Description of Artificial Sequence: Synthetic oligonucleotide
ctgcttaagtcctgaccag

SEQ ID NO: 304 - DNA, 19 bp, Artificial Sequence
  Description of Artificial Sequence: Synthetic oligonucleotide
ctgagcacctttcccttcc

SEQ ID NO: 305 - DNA, 15 bp, Artificial Sequence
  Description of Artificial Sequence: Synthetic oligonucleotide
ctagccccaaaccca

SEQ ID NO: 306 - DNA, 19 bp, Artificial Sequence
  Description of Artificial Sequence: Synthetic oligonucleotide
cggtcacacgattaaccca

SEQ ID NO: 307 - DNA, 16 bp, Artificial Sequence
  Description of Artificial Sequence: Synthetic oligonucleotide
cggggggaggaaaaaa

SEQ ID NO: 308 - DNA, 16 bp, Artificial Sequence
  Description of Artificial Sequence: Synthetic oligonucleotide
cggggggaaaaaaaaa

SEQ ID NO: 309 - DNA, 15 bp, Artificial Sequence
  Description of Artificial Sequence: Synthetic oligonucleotide
cggggccgcacgcgc

SEQ ID NO: 310 - DNA, 21 bp, Artificial Sequence
  Description of Artificial Sequence: Synthetic oligonucleotide
cgggagtggggtggcgcccag

SEQ ID NO: 311 - DNA, 15 bp, Artificial Sequence
  Description of Artificial Sequence: Synthetic oligonucleotide
cgggagccccgggtt

SEQ ID NO: 312 - DNA, 20 bp, Artificial Sequence
  Description of Artificial Sequence: Synthetic oligonucleotide
cggacctgataaattcccac

SEQ ID NO: 313 - DNA, 15 bp, Artificial Sequence
  Description of Artificial Sequence: Synthetic oligonucleotide
cgcggctcttgcggt

SEQ ID NO: 314 - DNA, 15 bp, Artificial Sequence
  Description of Artificial Sequence: Synthetic oligonucleotide
cgcctgagtcagaac

SEQ ID NO: 315 - DNA, 16 bp, Artificial Sequence
  Description of Artificial Sequence: Synthetic oligonucleotide
cgccgccgcccccccc

SEQ ID NO: 316 - DNA, 23 bp, Artificial Sequence
  Description of Artificial Sequence: Synthetic oligonucleotide
ccttccttggatgtctgagtgag

SEQ ID NO: 317 - DNA, 17 bp, Artificial Sequence
  Description of Artificial Sequence: Synthetic oligonucleotide
cctcgctggggcctcca

SEQ ID NO: 318 - DNA, 16 bp, Artificial Sequence
  Description of Artificial Sequence: Synthetic oligonucleotide
cctcacagggacgcca

SEQ ID NO: 319 - DNA, 18 bp, Artificial Sequence
  Description of Artificial Sequence: Synthetic oligonucleotide
cctaggagtgcgacaatt

SEQ ID NO: 320 - DNA, 15 bp, Artificial Sequence
  Description of Artificial Sequence: Synthetic oligonucleotide
ccgctctgagaccta

SEQ ID NO: 321 - DNA, 23 bp, Artificial Sequence
  Description of Artificial Sequence: Synthetic oligonucleotide
ccgcccgtcaccctcctcaagta

SEQ ID NO: 322 - DNA, 16 bp, Artificial Sequence
  Description of Artificial Sequence: Synthetic oligonucleotide
cccgggcggcacacca

SEQ ID NO: 323 - DNA, 23 bp, Artificial Sequence
  Description of Artificial Sequence: Synthetic oligonucleotide
cccgcgggcttgctgggcgtccc

SEQ ID NO: 324 - DNA, 17 bp, Artificial Sequence
  Description of Artificial Sequence: Synthetic oligonucleotide
cccctgcgatttcccca

SEQ ID NO: 325 - DNA, 17 bp, Artificial Sequence
  Description of Artificial Sequence: Synthetic oligonucleotide
ccccggcatctccacta

SEQ ID NO: 326 - DNA, 21 bp, Artificial Sequence
  Description of Artificial Sequence: Synthetic oligonucleotide
ccccagtgagtgccctcttcc

SEQ ID NO: 327 - DNA, 20 bp, Artificial Sequence
  Description of Artificial Sequence: Synthetic oligonucleotide
cccagagacgccgtcctcga

SEQ ID NO: 328 - DNA, 16 bp, Artificial Sequence
  Description of Artificial Sequence: Synthetic oligonucleotide
cccaccgaggatgcca

SEQ ID NO: 329 - DNA, 16 bp, Artificial Sequence
  Description of Artificial Sequence: Synthetic oligonucleotide
ccatcactacccacca

SEQ ID NO: 330 - DNA, 18 bp, Artificial Sequence
  Description of Artificial Sequence: Synthetic oligonucleotide
ccactccagcctagcccc

SEQ ID NO: 331 - DNA, 17 bp, Artificial Sequence
  Description of Artificial Sequence: Synthetic oligonucleotide
cagtacaggcacacctc

SEQ ID NO: 332 - DNA, 16 bp, Artificial Sequence
  Description of Artificial Sequence: Synthetic oligonucleotide
cacgtcggggtcccca

SEQ ID NO: 333 - DNA, 17 bp, Artificial Sequence
  Description of Artificial Sequence: Synthetic oligonucleotide
cacgattaacccaagtc

SEQ ID NO: 334 - DNA, 16 bp, Artificial Sequence
  Description of Artificial Sequence: Synthetic oligonucleotide
caccacacccgggcca

SEQ ID NO: 335 - DNA, 15 bp, Artificial Sequence
  Description of Artificial Sequence: Synthetic oligonucleotide
caacacaggcatgct

SEQ ID NO: 336 - DNA, 29 bp, Artificial Sequence
  Description of Artificial Sequence: Synthetic oligonucleotide
atagggtttacgacctcgatgttggatca

SEQ ID NO: 337 - DNA, 25 bp, Artificial Sequence
  Description of Artificial Sequence: Synthetic oligonucleotide
ataccatgatgaacaatagctgaga

SEQ ID NO: 338 - DNA, 16 bp, Artificial Sequence
  Description of Artificial Sequence: Synthetic oligonucleotide
agggttcagctgtctc

SEQ ID NO: 339 - DNA, 27 bp, Artificial Sequence
  Description of Artificial Sequence: Synthetic oligonucleotide
aggctgtgatggacctggctgagcctg

SEQ ID NO: 340 - DNA, 17 bp, Artificial Sequence
  Description of Artificial Sequence: Synthetic oligonucleotide
agagagtagggggaggt

SEQ ID NO: 341 - DNA, 17 bp, Artificial Sequence
  Description of Artificial Sequence: Synthetic oligonucleotide
actgtccctgtctacta

SEQ ID NO: 342 - DNA, 20 bp, Artificial Sequence
  Description of Artificial Sequence: Synthetic oligonucleotide
accgcatctggcctattttt

SEQ ID NO: 343 - DNA, 20 bp, Artificial Sequence
  Description of Artificial Sequence: Synthetic oligonucleotide
accagacctcctgtgcgaag

SEQ ID NO: 344 - DNA, 24 bp, Artificial Sequence
  Description of Artificial Sequence: Synthetic oligonucleotide
acagcccggatcccagcccactta

SEQ ID NO: 345 - DNA, 18 bp, Artificial Sequence
  Description of Artificial Sequence: Synthetic oligonucleotide
acactgagccacaaccca

SEQ ID NO: 346 - DNA, 18 bp, Artificial Sequence
  Description of Artificial Sequence: Synthetic oligonucleotide
aagggcttggcttaatta

SEQ ID NO: 347 - DNA, 23 bp, Artificial Sequence
  Description of Artificial Sequence: Synthetic oligonucleotide
aacccggaaggcggaggttgcgg

SEQ ID NO: 348 - DNA, 15 bp, Artificial Sequence
  Description of Artificial Sequence: Synthetic oligonucleotide
aaccccacaccaacc

SEQ ID NO: 349 - DNA, 27 bp, Artificial Sequence
  Description of Artificial Sequence: Synthetic oligonucleotide
aacaagcttctttgacgtcccatccac

SEQ ID NO: 350 - DNA, 18 bp, Artificial Sequence
  Description of Artificial Sequence: Synthetic oligonucleotide
tccccggcatctccacca

SEQ ID NO: 351 - DNA, 20 bp, Artificial Sequence
  Description of Artificial Sequence: Synthetic oligonucleotide
ctgattgctcctgtctgatt

SEQ ID NO: 352 - DNA, 21 bp, Artificial Sequence
  Description of Artificial Sequence: Synthetic oligonucleotide
tctagaggagcctgttctgta

SEQ ID NO: 353 - DNA, 22 bp, Artificial Sequence
  Description of Artificial Sequence: Synthetic oligonucleotide
tcgattcccggtcagggaacca

SEQ ID NO: 354 - DNA, 23 bp, Artificial Sequence
  Description of Artificial Sequence: Synthetic oligonucleotide
ataggtttggtcctagcctttct

SEQ ID NO: 355 - DNA, 18 bp, Artificial Sequence
  Description of Artificial Sequence: Synthetic oligonucleotide
cgttcgcgctttcccctg

SEQ ID NO: 356 - DNA, 17 bp, Artificial Sequence
  Description of Artificial Sequence: Synthetic oligonucleotide
taagtgtttgtgggtta

SEQ ID NO: 357 - DNA, 16 bp, Artificial Sequence
  Description of Artificial Sequence: Synthetic oligonucleotide
ggcggcgggagaccca

SEQ ID NO: 358 - DNA, 15 bp, Artificial Sequence
  Description of Artificial Sequence: Synthetic oligonucleotide
ccccggcaggtttga

SEQ ID NO: 359 - DNA, 22 bp, Artificial Sequence
  Description of Artificial Sequence: Synthetic oligonucleotide
tgccgtgatcgtatagtggtta

SEQ ID NO: 360 - DNA, 24 bp, Artificial Sequence
  Description of Artificial Sequence: Synthetic oligonucleotide
tcagactactctcctccgcccatt

SEQ ID NO: 361 - DNA, 16 bp, Artificial Sequence
  Description of Artificial Sequence: Synthetic oligonucleotide
ggacacagaggcttcg

SEQ ID NO: 362 - DNA, 20 bp, Artificial Sequence
  Description of Artificial Sequence: Synthetic oligonucleotide
ctgacagccggggttttgga

SEQ ID NO: 363 - DNA, 19 bp, Artificial Sequence
  Description of Artificial Sequence: Synthetic oligonucleotide
cggcggggcctggagtctg

SEQ ID NO: 364 - DNA, 17 bp, Artificial Sequence
  Description of Artificial Sequence: Synthetic oligonucleotide
cctggctcgctgcgcca

SEQ ID NO: 365 - DNA, 18 bp, Artificial Sequence
  Description of Artificial Sequence: Synthetic oligonucleotide
ccgccccaccccgcgcgc

SEQ ID NO: 366 - DNA, 18 bp, Artificial Sequence
  Description of Artificial Sequence: Synthetic oligonucleotide
cccgaacgctgccaaccc

SEQ ID NO: 367 - DNA, 23 bp, Artificial Sequence
  Description of Artificial Sequence: Synthetic oligonucleotide
agacccgcgggcgctctccagtc

SEQ ID NO: 368 - DNA, 24 bp, Artificial Sequence
  Description of Artificial Sequence: Synthetic oligonucleotide
cccccacaaccgcgcttgactagc

SEQ ID NO: 369 - DNA, 17 bp, Artificial Sequence
  Description of Artificial Sequence: Synthetic oligonucleotide
ccctgctcgctgcgcca

SEQ ID NO: 370 - DNA, 24 bp, Artificial Sequence
  Description of Artificial Sequence: Synthetic oligonucleotide
ctcccactgcttcacttgactagc

SEQ ID NO: 371 - DNA, 16 bp, Artificial Sequence
  Description of Artificial Sequence: Synthetic oligonucleotide
cccatcctcgtcgcca

SEQ ID NO: 372 - DNA, 17 bp, Artificial Sequence
  Description of Artificial Sequence: Synthetic oligonucleotide
tcacgtcggggtcacca

SEQ ID NO: 373 - DNA, 28 bp, Artificial Sequence
  Description of Artificial Sequence: Synthetic oligonucleotide
tccctggtggtctagtggttaggattcg

SEQ ID NO: 374 - DNA, 15 bp, Artificial Sequence
  Description of Artificial Sequence: Synthetic oligonucleotide
ggtagcgtggccgag

SEQ ID NO: 375 - DNA, 17 bp, Artificial Sequence
  Description of Artificial Sequence: Synthetic oligonucleotide
tcctgccgcggtcgcca

SEQ ID NO: 376 - DNA, 23 bp, Artificial Sequence
  Description of Artificial Sequence: Synthetic oligonucleotide
ggagagaacgcggtctgagtggt

SEQ ID NO: 377 - DNA, 22 bp, Artificial Sequence
  Description of Artificial Sequence: Synthetic oligonucleotide
tcgggtgcgagaggtcccgggt

SEQ ID NO: 378 - DNA, 23 bp, Artificial Sequence
  Description of Artificial Sequence: Synthetic oligonucleotide
ggctggtccgatggtagtgggtt

SEQ ID NO: 379 - DNA, 18 bp, Artificial Sequence
  Description of Artificial Sequence: Synthetic oligonucleotide
cggaagcgtgctgggccc

SEQ ID NO: 380 - DNA, 16 bp, Artificial Sequence
  Description of Artificial Sequence: Synthetic oligonucleotide
cccgggcggcgcacca

SEQ ID NO: 381 - DNA, 27 bp, Artificial Sequence
  Description of Artificial Sequence: Synthetic oligonucleotide
gcgggtgatgcgaactggagtctgagc

SEQ ID NO: 382 - DNA, 18 bp, Artificial Sequence
  Description of Artificial Sequence: Synthetic oligonucleotide
gacgaggtggccgagtgg

SEQ ID NO: 383 - DNA, 15 bp, Artificial Sequence
  Description of Artificial Sequence: Synthetic oligonucleotide
gggggtgtagctcag

SEQ ID NO: 384 - DNA, 18 bp, Artificial Sequence
  Description of Artificial Sequence: Synthetic oligonucleotide
ctcctggctggctcgcca

SEQ ID NO: 385 - DNA, 15 bp, Artificial Sequence
  Description of Artificial Sequence: Synthetic oligonucleotide
cgggaggcccgggtt

SEQ ID NO: 386 - DNA, 26 bp, Artificial Sequence
  Description of Artificial Sequence: Synthetic oligonucleotide
ggctggtccgagtgcagtggtgttta

SEQ ID NO: 387 - DNA, 17 bp, Artificial Sequence
  Description of Artificial Sequence: Synthetic oligonucleotide
ctgctgtgatgacattc

SEQ ID NO: 388 - DNA, 16 bp, Artificial Sequence
  Description of Artificial Sequence: Synthetic oligonucleotide
tgtcacgcgggagacc

SEQ ID NO: 389 - DNA, 28 bp, Artificial Sequence
  Description of Artificial Sequence: Synthetic oligonucleotide
tcctcgttagtatagtggtgagtatccc

SEQ ID NO: 390 - DNA, 15 bp, Artificial Sequence
  Description of Artificial Sequence: Synthetic oligonucleotide
ggccggttagctcag

SEQ ID NO: 391 - DNA, 22 bp, Artificial Sequence
  Description of Artificial Sequence: Synthetic oligonucleotide
gcattggtggttcagtggtaga

SEQ ID NO: 392 - DNA, 15 bp, Artificial Sequence
  Description of Artificial Sequence: Synthetic oligonucleotide
ctgtcacgcgggaga

SEQ ID NO: 393 - DNA, 16 bp, Artificial Sequence
  Description of Artificial Sequence: Synthetic oligonucleotide
ctacggggatgatttt

SEQ ID NO: 394 - DNA, 16 bp, Artificial Sequence
  Description of Artificial Sequence: Synthetic oligonucleotide
ccaggggctgagggca

SEQ ID NO: 395 - DNA, 22 bp, Artificial Sequence
  Description of Artificial Sequence: Synthetic oligonucleotide
ttctcactactgcacttgacta

SEQ ID NO: 396 - DNA, 17 bp, Artificial Sequence
  Description of Artificial Sequence: Synthetic oligonucleotide
tggttatcacgttcgcc

SEQ ID NO: 397 - DNA, 19 bp, Artificial Sequence
  Description of Artificial Sequence: Synthetic oligonucleotide
taggggtatgattctcgct

SEQ ID NO: 398 - DNA, 20 bp, Artificial Sequence
  Description of Artificial Sequence: Synthetic oligonucleotide
ccacgaggaagagaggtagc

SEQ ID NO: 399 - DNA, 21 bp, Artificial Sequence
  Description of Artificial Sequence: Synthetic oligonucleotide
gtcaggatggccgagcggtct

SEQ ID NO: 400 - DNA, 15 bp, Artificial Sequence
  Description of Artificial Sequence: Synthetic oligonucleotide
ggggatgtagctcag

SEQ ID NO: 401 - DNA, 15 bp, Artificial Sequence
  Description of Artificial Sequence: Synthetic oligonucleotide
gcagcgatggccgag

SEQ ID NO: 402 - DNA, 24 bp, Artificial Sequence
  Description of Artificial Sequence: Synthetic oligonucleotide
aatgacacgatcactcccgttgag

SEQ ID NO: 403 - DNA, 19 bp, Artificial Sequence
  Description of Artificial Sequence: Synthetic oligonucleotide
ggagggggggtaaaaaaaa

SEQ ID NO: 404 - DNA, 16 bp, Artificial Sequence
  Description of Artificial Sequence: Synthetic oligonucleotide
ccccggcatctccacc

SEQ ID NO: 405 - DNA, 20 bp, Artificial Sequence
  Description of Artificial Sequence: Synthetic oligonucleotide
gaagcgggtgctcttatttt

SEQ ID NO: 406 - DNA, 17 bp, Artificial Sequence
  Description of Artificial Sequence: Synthetic oligonucleotide
accgggcggaaacacca

SEQ ID NO: 407 - DNA, 30 bp, Artificial Sequence
  Description of Artificial Sequence: Synthetic oligonucleotide
tcccgggttcaaatcccggacgagccccca

SEQ ID NO: 408 - DNA, 19 bp, Artificial Sequence
  Description of Artificial Sequence: Synthetic oligonucleotide
gtgtaagcagggtcgtttt

SEQ ID NO: 409 - DNA, 18 bp, Artificial Sequence
  Description of Artificial Sequence: Synthetic oligonucleotide
atcccaccgctgctacca

SEQ ID NO: 410 - DNA, 16 bp, Artificial Sequence
  Description of Artificial Sequence: Synthetic oligonucleotide
gggaaggtgacctgac

SEQ ID NO: 411 - DNA, 17 bp, Artificial Sequence
  Description of Artificial Sequence: Synthetic oligonucleotide
ctcccgccttttttccc

SEQ ID NO: 412 - DNA, 14 bp, Artificial Sequence
  Description of Artificial Sequence: Synthetic oligonucleotide
cggagcaagagcgt

SEQ ID NO: 413 - DNA, 17 bp, Artificial Sequence
  Description of Artificial Sequence: Synthetic oligonucleotide
ccccgtactggccacca

SEQ ID NO: 414 - DNA, 18 bp, Artificial Sequence
  Description of Artificial Sequence: Synthetic oligonucleotide
cccccggcaccatcaata

SEQ ID NO: 415 - DNA, 17 bp, Artificial Sequence
  Description of Artificial Sequence: Synthetic oligonucleotide
cagcctagcccctaccc

SEQ ID NO: 416 - DNA, 17 bp, Artificial Sequence
  Description of Artificial Sequence: Synthetic oligonucleotide
cagaaggtctcactttt

SEQ ID NO: 417 - DNA, 18 bp, Artificial Sequence
  Description of Artificial Sequence: Synthetic oligonucleotide
agtattctctgtggcttt

SEQ ID NO: 418 - DNA, 24 bp, Artificial Sequence
  Description of Artificial Sequence: Synthetic oligonucleotide
tggagtgactatatggatgccccc

SEQ ID NO: 419 - DNA, 16 bp, Artificial Sequence
  Description of Artificial Sequence: Synthetic oligonucleotide
tctgatagcttacttt

SEQ ID NO: 420 - DNA, 20 bp, Artificial Sequence
  Description of Artificial Sequence: Synthetic oligonucleotide
tcgagccccagtggaaccac

SEQ ID NO: 421 - DNA, 22 bp, Artificial Sequence
  Description of Artificial Sequence: Synthetic oligonucleotide
tcgaatcctgttcgtgacgcca

SEQ ID NO: 422 - DNA, 27 bp, Artificial Sequence
  Description of Artificial Sequence: Synthetic oligonucleotide
tcctccccacactcatcgcccttacca

SEQ ID NO: 423 - DNA, 18 bp, Artificial Sequence
  Description of Artificial Sequence: Synthetic oligonucleotide
tatactacaaggacacca

SEQ ID NO: 424 - DNA, 21 bp, Artificial Sequence
  Description of Artificial Sequence: Synthetic oligonucleotide
tagtgggtgaaaaaaaaaaaa

SEQ ID NO: 425 - DNA, 24 bp, Artificial Sequence
  Description of Artificial Sequence: Synthetic oligonucleotide
taccacacattcgaagaacccgta

SEQ ID NO: 426 - DNA, 26 bp, Artificial Sequence
  Description of Artificial Sequence: Synthetic oligonucleotide
tacaaaacccaccccattcctcccca

SEQ ID NO: 427 - DNA, 18 bp, Artificial Sequence
  Description of Artificial Sequence: Synthetic oligonucleotide
gccctcctaatgacctcc

SEQ ID NO: 428 - DNA, 21 bp, Artificial Sequence
  Description of Artificial Sequence: Synthetic oligonucleotide
cttccctctacacttatcatc

SEQ ID NO: 429 - DNA, 19 bp, Artificial Sequence
  Description of Artificial Sequence: Synthetic oligonucleotide
cgggcggcctgcgctctca

SEQ ID NO: 430 - DNA, 23 bp, Artificial Sequence
  Description of Artificial Sequence: Synthetic oligonucleotide
cccgaggccgtgtgcaaatgcat

SEQ ID NO: 431 - DNA, 18 bp, Artificial Sequence
  Description of Artificial Sequence: Synthetic oligonucleotide
cccccagtacctccacca

SEQ ID NO: 432 - DNA, 27 bp, Artificial Sequence
  Description of Artificial Sequence: Synthetic oligonucleotide
cccccactgctaaacttgactggcttt

SEQ ID NO: 433 - DNA, 20 bp, Artificial Sequence
  Description of Artificial Sequence: Synthetic oligonucleotide
cccactccaccttactacca

SEQ ID NO: 434 - DNA, 19 bp, Artificial Sequence
  Description of Artificial Sequence: Synthetic oligonucleotide
cccaagaacagggtgacca

SEQ ID NO: 435 - DNA, 18 bp, Artificial Sequence
  Description of Artificial Sequence: Synthetic oligonucleotide
ccagtcgcggccaaatca

SEQ ID NO: 436 - DNA, 24 bp, Artificial Sequence
  Description of Artificial Sequence: Synthetic oligonucleotide
ccagcttcaccaaggtattggtta

SEQ ID NO: 437 - DNA, 18 bp, Artificial Sequence
  Description of Artificial Sequence: Synthetic oligonucleotide
ccagaaaaaacaggcctc

SEQ ID NO: 438 - DNA, 25 bp, Artificial Sequence
  Description of Artificial Sequence: Synthetic oligonucleotide
catcataatcggaggctttggcaac

SEQ ID NO: 439 - DNA, 26 bp, Artificial Sequence
  Description of Artificial Sequence: Synthetic oligonucleotide
cagcaggggtaataagtgaaatcaaa

SEQ ID NO: 440 - DNA, 28 bp, Artificial Sequence
  Description of Artificial Sequence: Synthetic oligonucleotide
caatggtgcagccgctattaaaggttca

SEQ ID NO: 441 - DNA, 21 bp, Artificial Sequence
  Description of Artificial Sequence: Synthetic oligonucleotide
caactcctacatacttccccc

SEQ ID NO: 442 - DNA, 18 bp, Artificial Sequence
  Description of Artificial Sequence: Synthetic oligonucleotide
attcaaaaaagagtacca

SEQ ID NO: 443 - DNA, 27 bp, Artificial Sequence
  Description of Artificial Sequence: Synthetic oligonucleotide
atgcatctcatatgcgaataggaatgc

SEQ ID NO: 444 - DNA, 17 bp, Artificial Sequence
  Description of Artificial Sequence: Synthetic oligonucleotide
atcccacttctgtacca

SEQ ID NO: 445 - DNA, 28 bp, Artificial Sequence
  Description of Artificial Sequence: Synthetic oligonucleotide
ataacactagaaagttggggcagattgc

SEQ ID NO: 446 - DNA, 28 bp, Artificial Sequence
  Description of Artificial Sequence: Synthetic oligonucleotide
acgtgggcacattacccgtctgacctga

SEQ ID NO: 447 - DNA, 16 bp, Artificial Sequence
  Description of Artificial Sequence: Synthetic oligonucleotide
accccttattaaccca

SEQ ID NO: 448 - DNA, 27 bp, Artificial Sequence
  Description of Artificial Sequence: Synthetic oligonucleotide
acaaggcacacctacaccccttatccc

SEQ ID NO: 449 - DNA, 19 bp, Artificial Sequence
  Description of Artificial Sequence: Synthetic oligonucleotide
aaaagacacccccccacca

SEQ ID NO: 450 - DNA, 21 bp, Artificial Sequence
  Description of Artificial Sequence: Synthetic oligonucleotide
aaaacccctacgcatttatat

SEQ ID NO: 451 - DNA, 19 bp, Artificial Sequence
  Description of Artificial Sequence: Synthetic oligonucleotide
aaaaagacaccccccacca

SEQ ID NO: 452 - DNA, 18 bp, Artificial Sequence
  Description of Artificial Sequence: Synthetic oligonucleotide
accccactcctggtacca

SEQ ID NO: 453 - DNA, 26 bp, Artificial Sequence
  Description of Artificial Sequence: Synthetic oligonucleotide
tgcccccatgtctaacaacatggcta

SEQ ID NO: 454 - DNA, 17 bp, Artificial Sequence
  Description of Artificial Sequence: Synthetic oligonucleotide
ggccggtgatgagaact

SEQ ID NO: 455 - DNA, 15 bp, Artificial Sequence
  Description of Artificial Sequence: Synthetic oligonucleotide
ccccgcctgtttacc

SEQ ID NO: 456 - DNA, 16 bp, Artificial Sequence
  Description of Artificial Sequence: Synthetic oligonucleotide
cccacttctgacacca

SEQ ID NO: 457 - DNA, 19 bp, Artificial Sequence
  Description of Artificial Sequence: Synthetic oligonucleotide
caccacctcttgctcagcc

SEQ ID NO: 458 - DNA, 24 bp, Artificial Sequence
  Description of Artificial Sequence: Synthetic oligonucleotide
ctggaaagtgcacttggacgaaca

SEQ ID NO: 459 - DNA, 16 bp, Artificial Sequence
  Description of Artificial Sequence: Synthetic oligonucleotide
tgaccgctctgaccac

SEQ ID NO: 460 - DNA, 20 bp, Artificial Sequence
  Description of Artificial Sequence: Synthetic oligonucleotide
tgaagtccctttgctttgtt

SEQ ID NO: 461 - DNA, 23 bp, Artificial Sequence
  Description of Artificial Sequence: Synthetic oligonucleotide
tgaacacacaatagctaagaccc

SEQ ID NO: 462 - DNA, 18 bp, Artificial Sequence
  Description of Artificial Sequence: Synthetic oligonucleotide
tcgccttaccccccacta

SEQ ID NO: 463 - DNA, 21 bp, Artificial Sequence
  Description of Artificial Sequence: Synthetic oligonucleotide
tcgataaaccccgatcaacct

SEQ ID NO: 464 - DNA, 18 bp, Artificial Sequence
  Description of Artificial Sequence: Synthetic oligonucleotide
tccccgtcacctccacca

SEQ ID NO: 465 - DNA, 17 bp, Artificial Sequence
  Description of Artificial Sequence: Synthetic oligonucleotide
tccccggcactccacca

SEQ ID NO: 466 - DNA, 17 bp, Artificial Sequence
  Description of Artificial Sequence: Synthetic oligonucleotide
tccccccgctgccacca

SEQ ID NO: 467 - DNA, 18 bp, Artificial Sequence
  Description of Artificial Sequence: Synthetic oligonucleotide
tcccccccatctccacca

SEQ ID NO: 468 - DNA, 19 bp, Artificial Sequence
  Description of Artificial Sequence: Synthetic oligonucleotide
tacacaccgcccgtcaccc

SEQ ID NO: 469 - DNA, 23 bp, Artificial Sequence
  Description of Artificial Sequence: Synthetic oligonucleotide
ggccggtgatgagaacttctccc

SEQ ID NO: 470 - DNA, 24 bp, Artificial Sequence
  Description of Artificial Sequence: Synthetic oligonucleotide
gcttagcctagccacacccccacg

SEQ ID NO: 471 - DNA, 19 bp, Artificial Sequence
  Description of Artificial Sequence: Synthetic oligonucleotide
gctcgccagaacactacga

SEQ ID NO: 472 - DNA, 17 bp, Artificial Sequence
  Description of Artificial Sequence: Synthetic oligonucleotide
gccggggggcgggcgca

SEQ ID NO: 473 - DNA, 19 bp, Artificial Sequence
  Description of Artificial Sequence: Synthetic oligonucleotide
gaaccgggcgggaacacca

SEQ ID NO: 474 - DNA, 20 bp, Artificial Sequence
  Description of Artificial Sequence: Synthetic oligonucleotide
cgccgcagtactgatcattc

SEQ ID NO: 475 - DNA, 20 bp, Artificial Sequence
  Description of Artificial Sequence: Synthetic oligonucleotide
ccgcaccaataggatcctcc

SEQ ID NO: 476 - DNA, 16 bp, Artificial Sequence
  Description of Artificial Sequence: Synthetic oligonucleotide
cccggccgacgcacca

SEQ ID NO: 477 - DNA, 20 bp, Artificial Sequence
  Description of Artificial Sequence: Synthetic oligonucleotide
ccaccccatcatactctttc

SEQ ID NO: 478 - DNA, 20 bp, Artificial Sequence
  Description of Artificial Sequence: Synthetic oligonucleotide
caccccccagctcctccttt

SEQ ID NO: 479 - DNA, 26 bp, Artificial Sequence
  Description of Artificial Sequence: Synthetic oligonucleotide
ataagtaacatgaaaacattctcctc

SEQ ID NO: 480 - DNA, 17 bp, Artificial Sequence
  Description of Artificial Sequence: Synthetic oligonucleotide
actgctcgccagaacac

SEQ ID NO: 481 - DNA, 25 bp, Artificial Sequence
  Description of Artificial Sequence: Synthetic oligonucleotide
accctggtgtgggatctgcccgatc

SEQ ID NO: 482 - DNA, 19 bp, Artificial Sequence
  Description of Artificial Sequence: Synthetic oligonucleotide
aacctcaccacctctttct

SEQ ID NO: 483 - DNA, 20 bp, Artificial Sequence
  Description of Artificial Sequence: Synthetic oligonucleotide
aaaagacaccccccacacca

SEQ ID NO: 484 - DNA, 21 bp, Artificial Sequence
  Description of Artificial Sequence: Synthetic oligonucleotide
gctaaacctagccccaaaccc

SEQ ID NO: 485 - DNA, 15 bp, Artificial Sequence
  Description of Artificial Sequence: Synthetic oligonucleotide
ggccgtgatcgtata

SEQ ID NO: 486 - DNA, 22 bp, Artificial Sequence
  Description of Artificial Sequence: Synthetic oligonucleotide
tgggatgcgagaggtcccgggt

SEQ ID NO: 487 - DNA, 17 bp, Artificial Sequence
  Description of Artificial Sequence: Synthetic oligonucleotide
ctgaactcctcacaccc

SEQ ID NO: 488 - DNA, 22 bp, Artificial Sequence
  Description of Artificial Sequence: Synthetic oligonucleotide
attaatcccctggcccaacccg

SEQ ID NO: 489 - DNA, 19 bp, Artificial Sequence
  Description of Artificial Sequence: Synthetic oligonucleotide
agccccaaacccactccac

SEQ ID NO: 490 - DNA, 18 bp, Artificial Sequence
  Description of Artificial Sequence: Synthetic oligonucleotide
cgcgacctcagatcagac

SEQ ID NO: 491 - DNA, 27 bp, Artificial Sequence
  Description of Artificial Sequence: Synthetic oligonucleotide
tcaagtgatgtcatcttactactgaga

SEQ ID NO: 492 - DNA, 22 bp, Artificial Sequence
  Description of Artificial Sequence: Synthetic oligonucleotide
ttgggtgcgagaggtcccgggt

SEQ ID NO: 493 - DNA, 17 bp, Artificial Sequence
  Description of Artificial Sequence: Synthetic oligonucleotide
tctcggtgggacctcca

SEQ ID NO: 494 - DNA, 17 bp, Artificial Sequence
  Description of Artificial Sequence: Synthetic oligonucleotide
ccgccccccgttccccc

SEQ ID NO: 495 - DNA, 24 bp, Artificial Sequence
  Description of Artificial Sequence: Synthetic oligonucleotide
cccactgctaaatttgactggctt

SEQ ID NO: 496 - DNA, 17 bp, Artificial Sequence
  Description of Artificial Sequence: Synthetic oligonucleotide
acagaccaagagccttc

SEQ ID NO: 497 - DNA, 25 bp, Artificial Sequence
  Description of Artificial Sequence: Synthetic oligonucleotide
tgtagtagtcaattaatggatatta

SEQ ID NO: 498 - DNA, 27 bp, Artificial Sequence
  Description of Artificial Sequence: Synthetic oligonucleotide
tggttatcacgttcgcctcacacgcga

SEQ ID NO: 499 - DNA, 15 bp, Artificial Sequence
  Description of Artificial Sequence: Synthetic oligonucleotide
tgggaataccgggtg

SEQ ID NO: 500 - DNA, 27 bp, Artificial Sequence
  Description of Artificial Sequence: Synthetic oligonucleotide
tggcggccaagcgttcatagcgacgtc

SEQ ID NO: 501 - DNA, 24 bp, Artificial Sequence
  Description of Artificial Sequence: Synthetic oligonucleotide
tcgtcatccagctaagggctcaga

SEQ ID NO: 502 - DNA, 26 bp, Artificial Sequence
  Description of Artificial Sequence: Synthetic oligonucleotide
tcgcctgccacgcgggaggcccgggt

SEQ ID NO: 503 - DNA, 18 bp, Artificial Sequence
  Description of Artificial Sequence: Synthetic oligonucleotide
tcccactgcttcacttga

SEQ ID NO: 504 - DNA, 25 bp, Artificial Sequence
  Description of Artificial Sequence: Synthetic oligonucleotide
gtttagacgggctcacatcacccca

SEQ ID NO: 505 - DNA, 21 bp, Artificial Sequence
  Description of Artificial Sequence: Synthetic oligonucleotide
gctaactcatgcccccatgtc

SEQ ID NO: 506 - DNA, 20 bp, Artificial Sequence
  Description of Artificial Sequence: Synthetic oligonucleotide
gactgtggtggttgaatata

SEQ ID NO: 507 - DNA, 27 bp, Artificial Sequence
  Description of Artificial Sequence: Synthetic oligonucleotide
cgcgacctcagatcagacgtggcgacc

SEQ ID NO: 508 - DNA, 15 bp, Artificial Sequence
  Description of Artificial Sequence: Synthetic oligonucleotide
cgccgccgccccccc

SEQ ID NO: 509 - DNA, 22 bp, Artificial Sequence
  Description of Artificial Sequence: Synthetic oligonucleotide
cgcccgactaccaccacatcca

SEQ ID NO: 510 - DNA, 17 bp, Artificial Sequence
  Description of Artificial Sequence: Synthetic oligonucleotide
cccccctccacgcgccc

SEQ ID NO: 511 - DNA, 17 bp, Artificial Sequence
  Description of Artificial Sequence: Synthetic oligonucleotide
ccccaccccgcgccctc

SEQ ID NO: 512 - DNA, 29 bp, Artificial Sequence
  Description of Artificial Sequence: Synthetic oligonucleotide
cagagtgtagcttaacacaaagcacccaa

SEQ ID NO: 513 - DNA, 29 bp, Artificial Sequence
  Description of Artificial Sequence: Synthetic oligonucleotide
caatcttggcatgttggtctggtcaccca

SEQ ID NO: 514 - DNA, 19 bp, Artificial Sequence
  Description of Artificial Sequence: Synthetic oligonucleotide
caaagcatcgcgaaggccc

SEQ ID NO: 515 - DNA, 25 bp, Artificial Sequence
  Description of Artificial Sequence: Synthetic oligonucleotide
aacaccctgattgctcctgtctgat

SEQ ID NO: 516 - DNA, 23 bp, Artificial Sequence
  Description of Artificial Sequence: Synthetic oligonucleotide
aaaaagggcctaaagaagatgca

SEQ ID NO: 517 - RNA, 23 nt, Artificial Sequence
  Description of Artificial Sequence: Synthetic oligonucleotide
ugucaguuuguuaauuaacccaa

SEQ ID NO: 518 - DNA, 19 bp, Artificial Sequence
  Description of Artificial Sequence: Synthetic oligonucleotide
actgtaggcaccatcaatc

SEQ ID NO: 519 - DNA, 17 bp, Artificial Sequence
  Description of Artificial Sequence: Synthetic oligonucleotide
atcgtaggcacctgaaa

SEQ ID NO: 520 - DNA, 15 bp, Artificial Sequence
  Description of Artificial Sequence: Synthetic primer
attgatggtgcctac

SEQ ID NO: 521 - DNA, 17 bp, Artificial Sequence
  Description of Artificial Sequence: Synthetic primer
atcgtaggcacctgaaa

SEQ ID NO: 522 - DNA, 17 bp, Artificial Sequence
  Description of Artificial Sequence: Synthetic primer
attgatggtgcctacag

SEQ ID NO: 523 - DNA, 16 bp, Artificial Sequence
  Description of Artificial Sequence: Synthetic primer
gtaaaacgacggccag

SEQ ID NO: 524 - DNA, 17 bp, Artificial Sequence
  Description of Artificial Sequence: Synthetic primer
caggaaacagctatgac

SEQ ID NO: 525 - DNA, 24 bp, Artificial Sequence
  Description of Artificial Sequence: Synthetic oligonucleotide
aatgacacgatcactcccgttgag

SEQ ID NO: 526 - DNA, 19 bp, Artificial Sequence
  Description of Artificial Sequence: Synthetic oligonucleotide
ggagggggggtaaaaaaaa

SEQ ID NO: 527 - DNA, 16 bp, Artificial Sequence
  Description of Artificial Sequence: Synthetic oligonucleotide
ccccggcatctccacc

SEQ ID NO: 528 - DNA, 20 bp, Artificial Sequence
  Description of Artificial Sequence: Synthetic oligonucleotide
gaagcgggtgctcttatttt

SEQ ID NO: 529 - DNA, 17 bp, Artificial Sequence
  Description of Artificial Sequence: Synthetic oligonucleotide
accgggcggaaacacca

SEQ ID NO: 530 - DNA, 30 bp, Artificial Sequence; identical to SEQ ID NO: 407
  Description of Artificial Sequence: Synthetic oligonucleotide

SEQ ID NO: 531 - DNA, 19 bp, Artificial Sequence
  Description of Artificial Sequence: Synthetic oligonucleotide
gtgtaagcagggtcgtttt

SEQ ID NO: 532 - DNA, 18 bp, Artificial Sequence
  Description of Artificial Sequence: Synthetic oligonucleotide
atcccaccgctgctacca

SEQ ID NO: 533 - DNA, 16 bp, Artificial Sequence
  Description of Artificial Sequence: Synthetic oligonucleotide
gggaaggtgacctgac

SEQ ID NO: 534 - DNA, 17 bp, Artificial Sequence
  Description of Artificial Sequence: Synthetic oligonucleotide
ctcccgccttttttccc

SEQ ID NO: 535 - DNA, 14 bp, Artificial Sequence
  Description of Artificial Sequence: Synthetic oligonucleotide
cggagcaagagcgt

SEQ ID NO: 536 - DNA, 17 bp, Artificial Sequence
  Description of Artificial Sequence: Synthetic oligonucleotide
ccccgtactggccacca

SEQ ID NO: 537 - DNA, 18 bp, Artificial Sequence
  Description of Artificial Sequence: Synthetic oligonucleotide
cccccggcaccatcaata

SEQ ID NO: 538 - DNA, 17 bp, Artificial Sequence
  Description of Artificial Sequence: Synthetic oligonucleotide
cagcctagcccctaccc

SEQ ID NO: 539 - DNA, 17 bp, Artificial Sequence
  Description of Artificial Sequence: Synthetic oligonucleotide
cagaaggtctcactttt

SEQ ID NO: 540 - DNA, 18 bp, Artificial Sequence
  Description of Artificial Sequence: Synthetic oligonucleotide
agtattctctgtggcttt

SEQ ID NO: 541 - DNA, 24 bp, Artificial Sequence
  Description of Artificial Sequence: Synthetic oligonucleotide
tggagtgactatatggatgccccc

SEQ ID NO: 542 - DNA, 16 bp, Artificial Sequence
  Description of Artificial Sequence: Synthetic oligonucleotide
tctgatagcttacttt

SEQ ID NO: 543 - DNA, 20 bp, Artificial Sequence
  Description of Artificial Sequence: Synthetic oligonucleotide
tcgagccccagtggaaccac

SEQ ID NO: 544 - DNA, 22 bp, Artificial Sequence
  Description of Artificial Sequence: Synthetic oligonucleotide
tcgaatcctgttcgtgacgcca

SEQ ID NO: 545 - DNA, 27 bp, Artificial Sequence
  Description of Artificial Sequence: Synthetic oligonucleotide
tcctccccacactcatcgcccttacca

SEQ ID NO: 546 - DNA, 18 bp, Artificial Sequence
  Description of Artificial Sequence: Synthetic oligonucleotide
tatactacaaggacacca

SEQ ID NO: 547 - DNA, 21 bp, Artificial Sequence
  Description of Artificial Sequence: Synthetic oligonucleotide
tagtgggtgaaaaaaaaaaaa

SEQ ID NO: 548 - DNA, 24 bp, Artificial Sequence
  Description of Artificial Sequence: Synthetic oligonucleotide
taccacacattcgaagaacccgta

SEQ ID NO: 549 - DNA, 26 bp, Artificial Sequence
  Description of Artificial Sequence: Synthetic oligonucleotide
tacaaaacccaccccattcctcccca

SEQ ID NO: 550 - DNA, 18 bp, Artificial Sequence
  Description of Artificial Sequence: Synthetic oligonucleotide
gccctcctaatgacctcc

SEQ ID NO: 551 - DNA, 21 bp, Artificial Sequence
  Description of Artificial Sequence: Synthetic oligonucleotide
cttccctctacacttatcatc

SEQ ID NO: 552 - DNA, 19 bp, Artificial Sequence
  Description of Artificial Sequence: Synthetic oligonucleotide
cgggcggcctgcgctctca

SEQ ID NO: 553 - DNA, 23 bp, Artificial Sequence
  Description of Artificial Sequence: Synthetic oligonucleotide
cccgaggccgtgtgcaaatgcat

SEQ ID NO: 554 - DNA, 18 bp, Artificial Sequence
  Description of Artificial Sequence: Synthetic oligonucleotide
cccccagtacctccacca

SEQ ID NO: 555 - DNA, 27 bp, Artificial Sequence
  Description of Artificial Sequence: Synthetic oligonucleotide
cccccactgctaaacttgactggcttt

SEQ ID NO: 556 - DNA, 20 bp, Artificial Sequence
  Description of Artificial Sequence: Synthetic oligonucleotide
cccactccaccttactacca

SEQ ID NO: 557 - DNA, 19 bp, Artificial Sequence
  Description of Artificial Sequence: Synthetic oligonucleotide
cccaagaacagggtgacca

SEQ ID NO: 558 - DNA, 18 bp, Artificial Sequence
  Description of Artificial Sequence: Synthetic oligonucleotide
ccagtcgcggccaaatca

SEQ ID NO: 559 - DNA, 24 bp, Artificial Sequence
  Description of Artificial Sequence: Synthetic oligonucleotide
ccagcttcaccaaggtattggtta

SEQ ID NO: 560 - DNA, 18 bp, Artificial Sequence
  Description of Artificial Sequence: Synthetic oligonucleotide
ccagaaaaaacaggcctc

SEQ ID NO: 561 - DNA, 25 bp, Artificial Sequence
  Description of Artificial Sequence: Synthetic oligonucleotide
catcataatcggaggctttggcaac

SEQ ID NO: 562 - DNA, 26 bp, Artificial Sequence
  Description of Artificial Sequence: Synthetic oligonucleotide
cagcaggggtaataagtgaaatcaaa

SEQ ID NO: 563 - DNA, 28 bp, Artificial Sequence
  Description of Artificial Sequence: Synthetic oligonucleotide
caatggtgcagccgctattaaaggttca

SEQ ID NO: 564 - DNA, 21 bp, Artificial Sequence
  Description of Artificial Sequence: Synthetic oligonucleotide
caactcctacatacttccccc

SEQ ID NO: 565 - DNA, 18 bp, Artificial Sequence
  Description of Artificial Sequence: Synthetic oligonucleotide
attcaaaaaagagtacca

SEQ ID NO: 566 - DNA, 27 bp, Artificial Sequence
  Description of Artificial Sequence: Synthetic oligonucleotide
atgcatctcatatgcgaataggaatgc

SEQ ID NO: 567 - DNA, 17 bp, Artificial Sequence
  Description of Artificial Sequence: Synthetic oligonucleotide
atcccacttctgtacca

SEQ ID NO: 568 - DNA, 28 bp, Artificial Sequence
  Description of Artificial Sequence: Synthetic oligonucleotide
ataacactagaaagttggggcagattgc

SEQ ID NO: 569 - DNA, 28 bp, Artificial Sequence
  Description of Artificial Sequence: Synthetic oligonucleotide
acgtgggcacattacccgtctgacctga

SEQ ID NO: 570 - DNA, 16 bp, Artificial Sequence
  Description of Artificial Sequence: Synthetic oligonucleotide
accccttattaaccca

SEQ ID NO: 571 - DNA, 27 bp, Artificial Sequence
  Description of Artificial Sequence: Synthetic oligonucleotide
acaaggcacacctacaccccttatccc

SEQ ID NO: 572 - DNA, 19 bp, Artificial Sequence
  Description of Artificial Sequence: Synthetic oligonucleotide
aaaagacacccccccacca

SEQ ID NO: 573 - DNA, 21 bp, Artificial Sequence
  Description of Artificial Sequence: Synthetic oligonucleotide
aaaacccctacgcatttatat

SEQ ID NO: 574 - DNA, 19 bp, Artificial Sequence
  Description of Artificial Sequence: Synthetic oligonucleotide
aaaaagacaccccccacca

SEQ ID NO: 575 - DNA, 18 bp, Artificial Sequence
  Description of Artificial Sequence: Synthetic oligonucleotide
accccactcctggtacca

SEQ ID NO: 576 - DNA, 26 bp, Artificial Sequence
  Description of Artificial Sequence: Synthetic oligonucleotide
tgcccccatgtctaacaacatggcta

SEQ ID NO: 577 - DNA, 17 bp, Artificial Sequence
  Description of Artificial Sequence: Synthetic oligonucleotide
ggccggtgatgagaact

SEQ ID NO: 578 - DNA, 15 bp, Artificial Sequence
  Description of Artificial Sequence: Synthetic oligonucleotide
ccccgcctgtttacc

SEQ ID NO: 579 - DNA, 16 bp, Artificial Sequence
  Description of Artificial Sequence: Synthetic oligonucleotide
cccacttctgacacca

SEQ ID NO: 580 - DNA, 19 bp, Artificial Sequence
  Description of Artificial Sequence: Synthetic oligonucleotide
caccacctcttgctcagcc

SEQ ID NO: 581 - DNA, 24 bp, Artificial Sequence
  Description of Artificial Sequence: Synthetic oligonucleotide
ctggaaagtgcacttggacgaaca

SEQ ID NO: 582 - DNA, 16 bp, Artificial Sequence
  Description of Artificial Sequence: Synthetic oligonucleotide
tgaccgctctgaccac

SEQ ID NO: 583 - DNA, 20 bp, Artificial Sequence
  Description of Artificial Sequence: Synthetic oligonucleotide
tgaagtccctttgctttgtt

SEQ ID NO: 584 - DNA, 23 bp, Artificial Sequence
  Description of Artificial Sequence: Synthetic oligonucleotide
tgaacacacaatagctaagaccc

SEQ ID NO: 585 - DNA, 18 bp, Artificial Sequence
  Description of Artificial Sequence: Synthetic oligonucleotide
tcgccttaccccccacta

SEQ ID NO: 586 - DNA, 21 bp, Artificial Sequence
  Description of Artificial Sequence: Synthetic oligonucleotide
tcgataaaccccgatcaacct

SEQ ID NO: 587 - DNA, 18 bp, Artificial Sequence
  Description of Artificial Sequence: Synthetic oligonucleotide
tccccgtcacctccacca

SEQ ID NO: 588 - DNA, 17 bp, Artificial Sequence
  Description of Artificial Sequence: Synthetic oligonucleotide
tccccggcactccacca

SEQ ID NO: 589 - DNA, 17 bp, Artificial Sequence
  Description of Artificial Sequence: Synthetic oligonucleotide
tccccccgctgccacca

SEQ ID NO: 590 - DNA, 18 bp, Artificial Sequence
  Description of Artificial Sequence: Synthetic oligonucleotide
tcccccccatctccacca

SEQ ID NO: 591 - DNA, 19 bp, Artificial Sequence
  Description of Artificial Sequence: Synthetic oligonucleotide
tacacaccgcccgtcaccc

SEQ ID NO: 592 - DNA, 23 bp, Artificial Sequence
  Description of Artificial Sequence: Synthetic oligonucleotide
ggccggtgatgagaacttctccc

SEQ ID NO: 593 - DNA, 24 bp, Artificial Sequence
  Description of Artificial Sequence: Synthetic oligonucleotide
gcttagcctagccacacccccacg

SEQ ID NO: 594 - DNA, 19 bp, Artificial Sequence
  Description of Artificial Sequence: Synthetic oligonucleotide
gctcgccagaacactacga

SEQ ID NO: 595 - DNA, 17 bp, Artificial Sequence
  Description of Artificial Sequence: Synthetic oligonucleotide
gccggggggcgggcgca

SEQ ID NO: 596 - DNA, 19 bp, Artificial Sequence
  Description of Artificial Sequence: Synthetic oligonucleotide
gaaccgggcgggaacacca

SEQ ID NO: 597 - DNA, 20 bp, Artificial Sequence
  Description of Artificial Sequence: Synthetic oligonucleotide
cgccgcagtactgatcattc

SEQ ID NO: 598 - DNA, 20 bp, Artificial Sequence
  Description of Artificial Sequence: Synthetic oligonucleotide
ccgcaccaataggatcctcc

SEQ ID NO: 599 - DNA, 16 bp, Artificial Sequence
  Description of Artificial Sequence: Synthetic oligonucleotide
cccggccgacgcacca

SEQ ID NO: 600 - DNA, 20 bp, Artificial Sequence
  Description of Artificial Sequence: Synthetic oligonucleotide
ccaccccatcatactctttc

SEQ ID NO: 601 - DNA, 20 bp, Artificial Sequence
  Description of Artificial Sequence: Synthetic oligonucleotide
caccccccagctcctccttt

SEQ ID NO: 602 - DNA, 26 bp, Artificial Sequence
  Description of Artificial Sequence: Synthetic oligonucleotide
ataagtaacatgaaaacattctcctc

SEQ ID NO: 603 - DNA, 17 bp, Artificial Sequence
  Description of Artificial Sequence: Synthetic oligonucleotide
actgctcgccagaacac

SEQ ID NO: 604 - DNA, 25 bp, Artificial Sequence
  Description of Artificial Sequence: Synthetic oligonucleotide
accctggtgtgggatctgcccgatc

SEQ ID NO: 605 - DNA, 19 bp, Artificial Sequence
  Description of Artificial Sequence: Synthetic oligonucleotide
aacctcaccacctctttct

SEQ ID NO: 606 - DNA, 20 bp, Artificial Sequence
  Description of Artificial Sequence: Synthetic oligonucleotide
aaaagacaccccccacacca

SEQ ID NO: 607 - DNA, 21 bp, Artificial Sequence
  Description of Artificial Sequence: Synthetic oligonucleotide
gctaaacctagccccaaaccc

SEQ ID NO: 608 - DNA, 15 bp, Artificial Sequence
  Description of Artificial Sequence: Synthetic oligonucleotide
ggccgtgatcgtata

SEQ ID NO: 609 - DNA, 22 bp, Artificial Sequence
  Description of Artificial Sequence: Synthetic oligonucleotide
tgggatgcgagaggtcccgggt

SEQ ID NO: 610 - DNA, 17 bp, Artificial Sequence
  Description of Artificial Sequence: Synthetic oligonucleotide
ctgaactcctcacaccc

SEQ ID NO: 611 - DNA, 22 bp, Artificial Sequence
  Description of Artificial Sequence: Synthetic oligonucleotide
attaatcccctggcccaacccg

SEQ ID NO: 612 - DNA, 19 bp, Artificial Sequence
  Description of Artificial Sequence: Synthetic oligonucleotide
agccccaaacccactccac

SEQ ID NO: 613 - DNA, 18 bp, Artificial Sequence
  Description of Artificial Sequence: Synthetic oligonucleotide
cgcgacctcagatcagac

SEQ ID NO: 614 - DNA, 27 bp, Artificial Sequence
  Description of Artificial Sequence: Synthetic oligonucleotide
tcaagtgatgtcatcttactactgaga

SEQ ID NO: 615 - DNA, 22 bp, Artificial Sequence
  Description of Artificial Sequence: Synthetic oligonucleotide
ttgggtgcgagaggtcccgggt

SEQ ID NO: 616 - DNA, 17 bp, Artificial Sequence
  Description of Artificial Sequence: Synthetic oligonucleotide
tctcggtgggacctcca

SEQ ID NO: 617 - DNA, 17 bp, Artificial Sequence
  Description of Artificial Sequence: Synthetic oligonucleotide
ccgccccccgttccccc

SEQ ID NO: 618 - DNA, 24 bp, Artificial Sequence
  Description of Artificial Sequence: Synthetic oligonucleotide
cccactgctaaatttgactggctt

SEQ ID NO: 619 - DNA, 17 bp, Artificial Sequence
  Description of Artificial Sequence: Synthetic oligonucleotide
acagaccaagagccttc

SEQ ID NO: 620 - DNA, 25 bp, Artificial Sequence
  Description of Artificial Sequence: Synthetic oligonucleotide
tgtagtagtcaattaatggatatta

SEQ ID NO: 621 - DNA, 27 bp, Artificial Sequence
  Description of Artificial Sequence: Synthetic oligonucleotide
tggttatcacgttcgcctcacacgcga

SEQ ID NO: 622 - DNA, 15 bp, Artificial Sequence
  Description of Artificial Sequence: Synthetic oligonucleotide
tgggaataccgggtg

SEQ ID NO: 623 - DNA, 27 bp, Artificial Sequence
  Description of Artificial Sequence: Synthetic oligonucleotide
tggcggccaagcgttcatagcgacgtc

SEQ ID NO: 624 - DNA, 24 bp, Artificial Sequence
  Description of Artificial Sequence: Synthetic oligonucleotide
tcgtcatccagctaagggctcaga

SEQ ID NO: 625 - DNA, 26 bp, Artificial Sequence
  Description of Artificial Sequence: Synthetic oligonucleotide
tcgcctgccacgcgggaggcccgggt

SEQ ID NO: 626 - DNA, 18 bp, Artificial Sequence
  Description of Artificial Sequence: Synthetic oligonucleotide
tcccactgcttcacttga

SEQ ID NO: 627 - DNA, 25 bp, Artificial Sequence
  Description of Artificial Sequence: Synthetic oligonucleotide
gtttagacgggctcacatcacccca

SEQ ID NO: 628 - DNA, 21 bp, Artificial Sequence
  Description of Artificial Sequence: Synthetic oligonucleotide
gctaactcatgcccccatgtc

SEQ ID NO: 629 - DNA, 20 bp, Artificial Sequence
  Description of Artificial Sequence: Synthetic oligonucleotide
gactgtggtggttgaatata

SEQ ID NO: 630 - DNA, 27 bp, Artificial Sequence
  Description of Artificial Sequence: Synthetic oligonucleotide
cgcgacctcagatcagacgtggcgacc

SEQ ID NO: 631 - DNA, 15 bp, Artificial Sequence
  Description of Artificial Sequence: Synthetic oligonucleotide
cgccgccgccccccc

SEQ ID NO: 632 - DNA, 22 bp, Artificial Sequence
  Description of Artificial Sequence: Synthetic oligonucleotide
cgcccgactaccaccacatcca

SEQ ID NO: 633 - DNA, 17 bp, Artificial Sequence
  Description of Artificial Sequence: Synthetic oligonucleotide
cccccctccacgcgccc

SEQ ID NO: 634 - DNA, 17 bp, Artificial Sequence
  Description of Artificial Sequence: Synthetic oligonucleotide
ccccaccccgcgccctc

SEQ ID NO: 635 - DNA, 29 bp, Artificial Sequence
  Description of Artificial Sequence: Synthetic oligonucleotide
cagagtgtagcttaacacaaagcacccaa

SEQ ID NO: 636 - DNA, 29 bp, Artificial Sequence
  Description of Artificial Sequence: Synthetic oligonucleotide
caatcttggcatgttggtctggtcaccca

SEQ ID NO: 637 - DNA, 19 bp, Artificial Sequence
  Description of Artificial Sequence: Synthetic oligonucleotide
caaagcatcgcgaaggccc

SEQ ID NO: 638 - DNA, 25 bp, Artificial Sequence
  Description of Artificial Sequence: Synthetic oligonucleotide
aacaccctgattgctcctgtctgat

SEQ ID NO: 639 - DNA, 23 bp, Artificial Sequence
  Description of Artificial Sequence: Synthetic oligonucleotide
aaaaagggcctaaagaagatgca

SEQ ID NO: 640 - DNA, 23 bp, Artificial Sequence
  Description of Artificial Sequence: Synthetic oligonucleotide
tggctcagttcagcaggaacagt

SEQ ID NO: 641 - DNA, 19 bp, Artificial Sequence
  Description of Artificial Sequence: Synthetic oligonucleotide
gtgggggagaggctgtcga

SEQ ID NO: 642 - DNA, 22 bp, Artificial Sequence
  Description of Artificial Sequence: Synthetic oligonucleotide
cggggcagctcagtacaggatt

SEQ ID NO: 643 - DNA, 23 bp, Artificial Sequence
  Description of Artificial Sequence: Synthetic oligonucleotide
aattgcacggtatccatctgtat

SEQ ID NO: 644 - DNA, 17 bp, Artificial Sequence
  Description of Artificial Sequence: Synthetic oligonucleotide
cgggggagcgccgcgta

SEQ ID NO: 645 - DNA, 22 bp, Artificial Sequence
  Description of Artificial Sequence: Synthetic oligonucleotide
tcgatcccgggtttcggcacca

SEQ ID NO: 646 - DNA, 23 bp, Artificial Sequence
  Description of Artificial Sequence: Synthetic oligonucleotide
atcgtatcccacttctgacacca

SEQ ID NO: 647 - DNA, 18 bp, Artificial Sequence
  Description of Artificial Sequence: Synthetic oligonucleotide
atcctgccgactacgcca

SEQ ID NO: 648 - DNA, 22 bp, Artificial Sequence
  Description of Artificial Sequence: Synthetic oligonucleotide
tcgaatcccactcctgacacca

SEQ ID NO: 649 - DNA, 18 bp, Artificial Sequence
  Description of Artificial Sequence: Synthetic oligonucleotide
atcccatcctcgtcgcca

SEQ ID NO: 650 - DNA, 22 bp, Artificial Sequence
  Description of Artificial Sequence: Synthetic oligonucleotide
tcgattccccgacggggagcca

SEQ ID NO: 651 - DNA, 18 bp, Artificial Sequence
  Description of Artificial Sequence: Synthetic oligonucleotide
atccgggtgccccctcca

SEQ ID NO: 652 - DNA, 17 bp, Artificial Sequence
  Description of Artificial Sequence: Synthetic oligonucleotide
tcccgggcggcgcacca

SEQ ID NO: 653 - DNA, 18 bp, Artificial Sequence
  Description of Artificial Sequence: Synthetic oligonucleotide
atcccaccagagtcgcca

SEQ ID NO: 654 - DNA, 22 bp, Artificial Sequence
  Description of Artificial Sequence: Synthetic oligonucleotide
tcaaatcacgtcggggtcacca

SEQ ID NO: 655 - DNA, 23 bp, Artificial Sequence
  Description of Artificial Sequence: Synthetic oligonucleotide
tgtcagtttgttaattgacccaa

SEQ ID NO: 656 - DNA, 22 bp, Artificial Sequence
  Description of Artificial Sequence: Synthetic oligonucleotide
tcgatccccgtacgggccacca

SEQ ID NO: 657 - DNA, 22 bp, Artificial Sequence
  Description of Artificial Sequence: Synthetic oligonucleotide
tcgagcctcacctggagcacca

SEQ ID NO: 658 - DNA, 17 bp, Artificial Sequence
  Description of Artificial Sequence: Synthetic oligonucleotide
tccggctcgaaggacca

SEQ ID NO: 659 - DNA, 18 bp, Artificial Sequence
  Description of Artificial Sequence: Synthetic oligonucleotide
ggcaatacgagcaccctg

SEQ ID NO: 660 - DNA, 16 bp, Artificial Sequence
  Description of Artificial Sequence: Synthetic oligonucleotide
ccggggcgtctcgtac

SEQ ID NO: 661 - DNA, 16 bp, Artificial Sequence
  Description of Artificial Sequence: Synthetic oligonucleotide
agcggctgtgcacaaa

SEQ ID NO: 662 - DNA, 20 bp, Artificial Sequence
  Description of Artificial Sequence: Synthetic oligonucleotide
tgtcagtttgtttaatccaa

SEQ ID NO: 663 - DNA, 20 bp, Artificial Sequence
  Description of Artificial Sequence: Synthetic oligonucleotide
tgtcagtttgttattaccaa

SEQ ID NO: 664 - DNA, 19 bp, Artificial Sequence
  Description of Artificial Sequence: Synthetic oligonucleotide
tgtcaggcaccatcaataa

SEQ ID NO: 665 - DNA, 20 bp, Artificial Sequence
  Description of Artificial Sequence: Synthetic oligonucleotide
tgatcttgacacttaaagcc

SEQ ID NO: 666 - DNA, 17 bp, Artificial Sequence
  Description of Artificial Sequence: Synthetic oligonucleotide
tcgtaggcaccatcaat

SEQ ID NO: 667 - DNA, 22 bp, Artificial Sequence
  Description of Artificial Sequence: Synthetic oligonucleotide
tcgactcccggtatgggaacca

SEQ ID NO: 668 - DNA, 23 bp, Artificial Sequence
  Description of Artificial Sequence: Synthetic oligonucleotide
tagggaggttatgattaactttt

SEQ ID NO: 669 - DNA, 20 bp, Artificial Sequence
  Description of Artificial Sequence: Synthetic oligonucleotide
taaagtgcttagtgcaggta

SEQ ID NO: 670 - DNA, 19 bp, Artificial Sequence
  Description of Artificial Sequence: Synthetic oligonucleotide
gtttatgttgcttacctcc

SEQ ID NO: 671 - DNA, 18 bp, Artificial Sequence
  Description of Artificial Sequence: Synthetic oligonucleotide
gtagataaaatattggcg

SEQ ID NO: 672 - DNA, 17 bp, Artificial Sequence
  Description of Artificial Sequence: Synthetic oligonucleotide
ggcggggacgacgtcag

SEQ ID NO: 673 - DNA, 19 bp, Artificial Sequence
  Description of Artificial Sequence: Synthetic oligonucleotide
ggcggcgtcgcggcgggtc

SEQ ID NO: 674 - DNA, 24 bp, Artificial Sequence
  Description of Artificial Sequence: Synthetic oligonucleotide
ggagggggtgaacaaaaagaaaaa

SEQ ID NO: 675 - DNA, 29 bp, Artificial Sequence
  Description of Artificial Sequence: Synthetic oligonucleotide
gctaaacctagccccaaacccactccaca

SEQ ID NO: 676 - DNA, 19 bp, Artificial Sequence
  Description of Artificial Sequence: Synthetic oligonucleotide
ctggatagcgcacttcgtt

SEQ ID NO: 677 - DNA, 21 bp, Artificial Sequence
  Description of Artificial Sequence: Synthetic oligonucleotide
cgggcgaggggcggacgttcg

SEQ ID NO: 678 - DNA, 15 bp, Artificial Sequence
  Description of Artificial Sequence: Synthetic oligonucleotide
cggacctataccgga

SEQ ID NO: 679 - DNA, 30 bp, Artificial Sequence
  Description of Artificial Sequence: Synthetic oligonucleotide
ccccgggttcaatccccggcacctccacca

SEQ ID NO: 680 - DNA, 17 bp, Artificial Sequence
  Description of Artificial Sequence: Synthetic oligonucleotide
ccccccacaaccgcgaa

SEQ ID NO: 681 - DNA, 20 bp, Artificial Sequence
  Description of Artificial Sequence: Synthetic oligonucleotide
cccagcatctcctgtgttta

SEQ ID NO: 682 - DNA, 17 bp, Artificial Sequence
  Description of Artificial Sequence: Synthetic oligonucleotide
cccacgttgggacgcca

SEQ ID NO: 683 - DNA, 18 bp, Artificial Sequence
  Description of Artificial Sequence: Synthetic oligonucleotide
atcacgtccgtgcctcca

SEQ ID NO: 684 - DNA, 21 bp, Artificial Sequence
  Description of Artificial Sequence: Synthetic oligonucleotide
atagcaatgtcagcagtacct

SEQ ID NO: 685 - DNA, 18 bp, Artificial Sequence
  Description of Artificial Sequence: Synthetic oligonucleotide
accctgctcgctgcgcca

SEQ ID NO: 686 - DNA, 18 bp, Artificial Sequence
  Description of Artificial Sequence: Synthetic oligonucleotide
tcccacccagggacgcca

SEQ ID NO: 687 - DNA, 17 bp, Artificial Sequence
  Description of Artificial Sequence: Synthetic oligonucleotide
tcgtaggcacatcaata

SEQ ID NO: 688 - DNA, 16 bp, Artificial Sequence
  Description of Artificial Sequence: Synthetic oligonucleotide
cccccacaaccgcgta

SEQ ID NO: 689 - DNA, 18 bp, Artificial Sequence
  Description of Artificial Sequence: Synthetic oligonucleotide
accccgtccgtgcctcca

SEQ ID NO: 690 - DNA, 19 bp, Artificial Sequence
  Description of Artificial Sequence: Synthetic oligonucleotide
aaaaaagacaccccccaca

SEQ ID NO: 691 - DNA, 19 bp, Artificial Sequence
  Description of Artificial Sequence: Synthetic oligonucleotide
tgtcagtttgttaacccaa

SEQ ID NO: 692 - DNA, 22 bp, Artificial Sequence
  Description of Artificial Sequence: Synthetic oligonucleotide
tccctgtggtctagtggttagg

SEQ ID NO: 693 - DNA, 15 bp, Artificial Sequence
  Description of Artificial Sequence: Synthetic oligonucleotide
gggggggtaaaaaaa

SEQ ID NO: 694 - DNA, 16 bp, Artificial Sequence
  Description of Artificial Sequence: Synthetic oligonucleotide
ggggggggaaaaaaaa

SEQ ID NO: 695 - DNA, 17 bp, Artificial Sequence
  Description of Artificial Sequence: Synthetic oligonucleotide
cgggcccgggtcttccc

SEQ ID NO: 696 - DNA, 19 bp, Artificial Sequence
  Description of Artificial Sequence: Synthetic oligonucleotide
ccgccccccgttcccccca

SEQ ID NO: 697 - DNA, 19 bp, Artificial Sequence
  Description of Artificial Sequence: Synthetic oligonucleotide
acccccggctcctccacca

SEQ ID NO: 698 - DNA, 19 bp, Artificial Sequence
  Description of Artificial Sequence: Synthetic oligonucleotide
tttggtggaaattttttga

SEQ ID NO: 699 - DNA, 19 bp, Artificial Sequence
  Description of Artificial Sequence: Synthetic oligonucleotide
tgtcagtttgttataccaa

SEQ ID NO: 700 - DNA, 22 bp, Artificial Sequence
  Description of Artificial Sequence: Synthetic oligonucleotide
tgtcagtttgtaattatcccaa

SEQ ID NO: 701 - DNA, 18 bp, Artificial Sequence
  Description of Artificial Sequence: Synthetic oligonucleotide
tgtcaatttttaacccaa

SEQ ID NO: 702 - DNA, 19 bp, Artificial Sequence
  Description of Artificial Sequence: Synthetic oligonucleotide
tgctagggtaaaaaaaaaa

SEQ ID NO: 703 - DNA, 23 bp, Artificial Sequence
  Description of Artificial Sequence: Synthetic oligonucleotide
tgcaactccaaataaaagtacca

SEQ ID NO: 704 - DNA, 18 bp, Artificial Sequence
  Description of Artificial Sequence: Synthetic oligonucleotide
tgaggtaacggggaatta

SEQ ID NO: 705 - DNA, 18 bp, Artificial Sequence
  Description of Artificial Sequence: Synthetic oligonucleotide
tcctcggcatctccacca

SEQ ID NO: 706 - DNA, 24 bp, Artificial Sequence
  Description of Artificial Sequence: Synthetic oligonucleotide
tcatatgaagtcaccctagccatc

SEQ ID NO: 707 - DNA, 21 bp, Artificial Sequence
  Description of Artificial Sequence: Synthetic oligonucleotide
tcagtttgtttattaacccaa

SEQ ID NO: 708 - DNA, 18 bp, Artificial Sequence
  Description of Artificial Sequence: Synthetic oligonucleotide
tcagcgtgtctttgccct

SEQ ID NO: 709 - DNA, 19 bp, Artificial Sequence
  Description of Artificial Sequence: Synthetic oligonucleotide
tcactggtggtctagtggt

SEQ ID NO: 710 - DNA, 17 bp, Artificial Sequence
  Description of Artificial Sequence: Synthetic oligonucleotide
tcacaatgctgccacca

SEQ ID NO: 711 - DNA, 19 bp, Artificial Sequence
  Description of Artificial Sequence: Synthetic oligonucleotide
tagttgttaattaacccaa

SEQ ID NO: 712 - DNA, 18 bp, Artificial Sequence
  Description of Artificial Sequence: Synthetic oligonucleotide
tagtcctcatcgccctcc

SEQ ID NO: 713 - DNA, 23 bp, Artificial Sequence
  Description of Artificial Sequence: Synthetic oligonucleotide
taaagtgcttatagtgcgggtaa

SEQ ID NO: 714 - DNA, 18 bp, Artificial Sequence
  Description of Artificial Sequence: Synthetic oligonucleotide
gtcccaccagagtcgcca

SEQ ID NO: 715 - DNA, 19 bp, Artificial Sequence
  Description of Artificial Sequence: Synthetic oligonucleotide
gggggaggggccaaaaaaa

SEQ ID NO: 716 - DNA, 17 bp, Artificial Sequence
  Description of Artificial Sequence: Synthetic oligonucleotide
gggacgccgcggtgtcg

SEQ ID NO: 717 - DNA, 24 bp, Artificial Sequence
  Description of Artificial Sequence: Synthetic oligonucleotide
gggaataccgggtgctttaggctt

SEQ ID NO: 718 - DNA, 19 bp, Artificial Sequence
  Description of Artificial Sequence: Synthetic oligonucleotide
ggaagaaggtggtggtata

SEQ ID NO: 719 - DNA, 15 bp, Artificial Sequence
  Description of Artificial Sequence: Synthetic oligonucleotide
gcggtgaaatgcgta

SEQ ID NO: 720 - DNA, 17 bp, Artificial Sequence
  Description of Artificial Sequence: Synthetic oligonucleotide
gcggggaaggtggcaaa

SEQ ID NO: 721 - DNA, 26 bp, Artificial Sequence
  Description of Artificial Sequence: Synthetic oligonucleotide
gcgacgacctcgcgcccacctggtca

SEQ ID NO: 722 - DNA, 18 bp, Artificial Sequence
  Description of Artificial Sequence: Synthetic oligonucleotide
gccacccgatactgctgt

SEQ ID NO: 723 - DNA, 21 bp, Artificial Sequence
  Description of Artificial Sequence: Synthetic oligonucleotide
gatgtatgctttgtttctgtt

SEQ ID NO: 724 - DNA, 20 bp, Artificial Sequence
  Description of Artificial Sequence: Synthetic oligonucleotide
gagggggatttagaaaaaaa

SEQ ID NO: 725 - DNA, 18 bp, Artificial Sequence
  Description of Artificial Sequence: Synthetic oligonucleotide
gaaggaaagttctatagt

SEQ ID NO: 726 - DNA, 18 bp, Artificial Sequence
  Description of Artificial Sequence: Synthetic oligonucleotide
gaagcggctctcttattt

SEQ ID NO: 727 - DNA, 22 bp, Artificial Sequence
  Description of Artificial Sequence: Synthetic oligonucleotide
gaacgagactctggcatgctga

SEQ ID NO: 728 - DNA, 17 bp, Artificial Sequence
  Description of Artificial Sequence: Synthetic oligonucleotide
ctggtaggcccatcaat

SEQ ID NO: 729 - DNA, 17 bp, Artificial Sequence
  Description of Artificial Sequence: Synthetic oligonucleotide
cggggccgatcgcgcgc

SEQ ID NO: 730 - DNA, 18 bp, Artificial Sequence
  Description of Artificial Sequence: Synthetic oligonucleotide
cggccccgggttcctccc

SEQ ID NO: 731 - DNA, 15 bp, Artificial Sequence
  Description of Artificial Sequence: Synthetic oligonucleotide
cgagcccggttagta

SEQ ID NO: 732 - DNA, 17 bp, Artificial Sequence
  Description of Artificial Sequence: Synthetic oligonucleotide
cgactcttagcggtgga

SEQ ID NO: 733 - DNA, 21 bp, Artificial Sequence
  Description of Artificial Sequence: Synthetic oligonucleotide
cgaatcccacttctgacacca

SEQ ID NO: 734 - DNA, 17 bp, Artificial Sequence
  Description of Artificial Sequence: Synthetic oligonucleotide
cgaaagggaatcgggtc

SEQ ID NO: 735 - DNA, 18 bp, Artificial Sequence
  Description of Artificial Sequence: Synthetic oligonucleotide
ccttaggtcgctggtaaa

SEQ ID NO: 736 - DNA, 16 bp, Artificial Sequence
  Description of Artificial Sequence: Synthetic oligonucleotide
ccgtgcgagaatacca

SEQ ID NO: 737 - DNA, 18 bp, Artificial Sequence
  Description of Artificial Sequence: Synthetic oligonucleotide
ccggtctctcaagcggcc

SEQ ID NO: 738 - DNA, 18 bp, Artificial Sequence
  Description of Artificial Sequence: Synthetic oligonucleotide
cccggccctcgcgcgtcc

SEQ ID NO: 739 - DNA, 17 bp, Artificial Sequence
  Description of Artificial Sequence: Synthetic oligonucleotide
ccccggcatttccacca

SEQ ID NO: 740 - DNA, 20 bp, Artificial Sequence
  Description of Artificial Sequence: Synthetic oligonucleotide
cccccccggctcctccacca

SEQ ID NO: 741 - DNA, 16 bp, Artificial Sequence
  Description of Artificial Sequence: Synthetic oligonucleotide
ccccccacaaccgcta

SEQ ID NO: 742 - DNA, 19 bp, Artificial Sequence
  Description of Artificial Sequence: Synthetic oligonucleotide
cccaagtattgactcaccc

SEQ ID NO: 743 - DNA, 16 bp, Artificial Sequence
  Description of Artificial Sequence: Synthetic oligonucleotide
ccagtaagcgcgagtc

SEQ ID NO: 744 - DNA, 19 bp, Artificial Sequence
  Description of Artificial Sequence: Synthetic oligonucleotide
ccaaagaaagcacgtagag

SEQ ID NO: 745 - DNA, 19 bp, Artificial Sequence
  Description of Artificial Sequence: Synthetic oligonucleotide
catgtttaacggccgcggt

SEQ ID NO: 746 - DNA, 19 bp, Artificial Sequence
  Description of Artificial Sequence: Synthetic oligonucleotide
cagtttgtaattaacccaa

SEQ ID NO: 747 - DNA, 16 bp, Artificial Sequence
  Description of Artificial Sequence: Synthetic oligonucleotide
caggaacggcgcacca

SEQ ID NO: 748 - DNA, 19 bp, Artificial Sequence
  Description of Artificial Sequence: Synthetic oligonucleotide
cagaaccctctaaatcccc

SEQ ID NO: 749 - DNA, 23 bp, Artificial Sequence
  Description of Artificial Sequence: Synthetic oligonucleotide
cacccggctgtgtgcacatgtgt

SEQ ID NO: 750 - DNA, 18 bp, Artificial Sequence
  Description of Artificial Sequence: Synthetic oligonucleotide
caattggaccaatctatc

SEQ ID NO: 751 - DNA, 17 bp, Artificial Sequence
  Description of Artificial Sequence: Synthetic oligonucleotide
attcctgtactgcgata

SEQ ID NO: 752 - DNA, 18 bp, Artificial Sequence
  Description of Artificial Sequence: Synthetic oligonucleotide
atccctgcggcgtctcca

SEQ ID NO: 753 - DNA, 18 bp, Artificial Sequence
  Description of Artificial Sequence: Synthetic oligonucleotide
atcccaccgctgccatca

SEQ ID NO: 754 - DNA, 20 bp, Artificial Sequence
  Description of Artificial Sequence: Synthetic oligonucleotide
agtcaatagaagccggcgta

SEQ ID NO: 755 - DNA, 17 bp, Artificial Sequence
  Description of Artificial Sequence: Synthetic oligonucleotide
aggttcgtttgtaaaaa

SEQ ID NO: 756 - DNA, 19 bp, Artificial Sequence
  Description of Artificial Sequence: Synthetic oligonucleotide
aggtcctgggtttaagtgt

SEQ ID NO: 757 - DNA, 19 bp, Artificial Sequence
  Description of Artificial Sequence: Synthetic oligonucleotide
agggggaagttctatagtc

SEQ ID NO: 758 - DNA, 25 bp, Artificial Sequence
  Description of Artificial Sequence: Synthetic oligonucleotide
  modified_base (17)..(17): a, c, t, g, unknown or other
aggctgtgatgctctcntgagccct

SEQ ID NO: 759 - DNA, 19 bp, Artificial Sequence
  Description of Artificial Sequence: Synthetic oligonucleotide
agcccctctccggccctta

SEQ ID NO: 760 - DNA, 17 bp, Artificial Sequence
  Description of Artificial Sequence: Synthetic oligonucleotide
actaccacctacctccc

SEQ ID NO: 761 - DNA, 21 bp, Artificial Sequence
  Description of Artificial Sequence: Synthetic oligonucleotide
acgcccttcccccccttcttt

SEQ ID NO: 762 - DNA, 18 bp, Artificial Sequence
  Description of Artificial Sequence: Synthetic oligonucleotide
accccactcctggtgcac

SEQ ID NO: 763 - DNA, 18 bp, Artificial Sequence
  Description of Artificial Sequence: Synthetic oligonucleotide
accacctgatcccttccc

SEQ ID NO: 764 - DNA, 18 bp, Artificial Sequence
  Description of Artificial Sequence: Synthetic oligonucleotide
acagctaagcacccacca

SEQ ID NO: 765 - DNA, 17 bp, Artificial Sequence
  Description of Artificial Sequence: Synthetic oligonucleotide
acacatgtttaacggcc

SEQ ID NO: 766 - DNA, 17 bp, Artificial Sequence
  Description of Artificial Sequence: Synthetic oligonucleotide
aattagggacctgtatg

SEQ ID NO: 767 - DNA, 21 bp, Artificial Sequence
  Description of Artificial Sequence: Synthetic oligonucleotide
aatggcccatttgggcaaaca

SEQ ID NO: 768 - DNA, 18 bp, Artificial Sequence
  Description of Artificial Sequence: Synthetic oligonucleotide
aaagcggctgtgcaaaca

SEQ ID NO: 769 - DNA, 22 bp, Artificial Sequence
  Description of Artificial Sequence: Synthetic oligonucleotide
tcgactcctggctggctcgcca

SEQ ID NO: 770 - DNA, 19 bp, Artificial Sequence
  Description of Artificial Sequence: Synthetic oligonucleotide
tccccggcatctccaccaa

SEQ ID NO: 771 - DNA, 25 bp, Artificial Sequence
  Description of Artificial Sequence: Synthetic oligonucleotide
gcggtggatcactcggctcgtgcgt

SEQ ID NO: 772 - DNA, 14 bp, Artificial Sequence
  Description of Artificial Sequence: Synthetic oligonucleotide
ccgggtgttgtaga

SEQ ID NO: 773 - DNA, 19 bp, Artificial Sequence
  Description of Artificial Sequence: Synthetic oligonucleotide
tgtagcgtggccgagcggt

SEQ ID NO: 774 - DNA, 19 bp, Artificial Sequence
  Description of Artificial Sequence: Synthetic oligonucleotide
tggggcgacctcggagcag

SEQ ID NO: 775 - DNA, 27 bp, Artificial Sequence
  Description of Artificial Sequence: Synthetic oligonucleotide
tggcgtcctaagccagggattgtgggt

SEQ ID NO: 776 - DNA, 23 bp, Artificial Sequence
  Description of Artificial Sequence: Synthetic oligonucleotide
tggcaggggagataccatgattt

SEQ ID NO: 777 - DNA, 19 bp, Artificial Sequence
  Description of Artificial Sequence: Synthetic oligonucleotide
tctgatcagggtgagcatc

SEQ ID NO: 778 - DNA, 17 bp, Artificial Sequence
  Description of Artificial Sequence: Synthetic oligonucleotide
tcgtaggcaccatccat

SEQ ID NO: 779 - DNA, 19 bp, Artificial Sequence
  Description of Artificial Sequence: Synthetic oligonucleotide
gggaaacggggcgcggctg

SEQ ID NO: 780 - DNA, 24 bp, Artificial Sequence
  Description of Artificial Sequence: Synthetic oligonucleotide
ctactcctgctcgcatctgctata

SEQ ID NO: 781 - DNA, 18 bp, Artificial Sequence
  Description of Artificial Sequence: Synthetic oligonucleotide
cgggtgggtttttaccgg

SEQ ID NO: 782 - DNA, 18 bp, Artificial Sequence
  Description of Artificial Sequence: Synthetic oligonucleotide
cgaggaattcccagtaag

SEQ ID NO: 783 - DNA, 19 bp, Artificial Sequence
  Description of Artificial Sequence: Synthetic oligonucleotide
cgaacgcacttgcggcccc

SEQ ID NO: 784 - DNA, 19 bp, Artificial Sequence
  Description of Artificial Sequence: Synthetic oligonucleotide
ccccgcgcgggttcgaatc

SEQ ID NO: 785 - DNA, 19 bp, Artificial Sequence
  Description of Artificial Sequence: Synthetic oligonucleotide
aggggtatgattcccgctt

SEQ ID NO: 786 - DNA, 18 bp, Artificial Sequence
  Description of Artificial Sequence: Synthetic oligonucleotide
cggggccacgcgcgcgtc

SEQ ID NO: 787 - DNA, 18 bp, Artificial Sequence
  Description of Artificial Sequence: Synthetic oligonucleotide
tggcgctgcgggatgaac

SEQ ID NO: 788 - DNA, 27 bp, Artificial Sequence
  Description of Artificial Sequence: Synthetic oligonucleotide
ccccccactgctaaatttgactggctt

SEQ ID NO: 789 - DNA, 19 bp, Artificial Sequence
  Description of Artificial Sequence: Synthetic oligonucleotide
taaaggttcgtttgtaaaa

SEQ ID NO: 790 - DNA, 17 bp, Artificial Sequence
  Description of Artificial Sequence: Synthetic oligonucleotide
cggggccgagggagcga

SEQ ID NO: 791 - DNA, 16 bp, Artificial Sequence
  Description of Artificial Sequence: Synthetic oligonucleotide
gggttaggcctctttt

SEQ ID NO: 792 - DNA, 17 bp, Artificial Sequence
  Description of Artificial Sequence: Synthetic oligonucleotide
ctgcggaaggatcatta

SEQ ID NO: 793 - DNA, 14 bp, Artificial Sequence
  Description of Artificial Sequence: Synthetic oligonucleotide
ccctacccccccgg

SEQ ID NO: 794 - DNA, 16 bp, Artificial Sequence
  Description of Artificial Sequence: Synthetic oligonucleotide
cccgccgggtccgccc

SEQ ID NO: 795 - DNA, 20 bp, Artificial Sequence
  Description of Artificial Sequence: Synthetic oligonucleotide
ccccgcgccctctctctctc

SEQ ID NO: 796 - DNA, 17 bp, Artificial Sequence
  Description of Artificial Sequence: Synthetic oligonucleotide
caggcctccctggaatc

SEQ ID NO: 797 - DNA, 19 bp, Artificial Sequence
  Description of Artificial Sequence: Synthetic oligonucleotide
agtcccacccggggtacca

SEQ ID NO: 798 - DNA, 22 bp, Artificial Sequence
  Description of Artificial Sequence: Synthetic oligonucleotide
ttgacacgccccagtgccctgt

SEQ ID NO: 799 - DNA, 19 bp, Artificial Sequence
  Description of Artificial Sequence: Synthetic oligonucleotide
tgggagcgggcgggcggtc

SEQ ID NO: 800 - DNA, 18 bp, Artificial Sequence
  Description of Artificial Sequence: Synthetic oligonucleotide
tggcgtggagccgggcgt

SEQ ID NO: 801 - DNA, 17 bp, Artificial Sequence
  Description of Artificial Sequence: Synthetic oligonucleotide
tggaggtccgtagcggt

SEQ ID NO: 802 - DNA, 18 bp, Artificial Sequence
  Description of Artificial Sequence: Synthetic oligonucleotide
tgaagaaggtctcgaaca

SEQ ID NO: 803 - DNA, 17 bp, Artificial Sequence
  Description of Artificial Sequence: Synthetic oligonucleotide
tctcgccggggcttcca

SEQ ID NO: 804 - DNA, 18 bp, Artificial Sequence
  Description of Artificial Sequence: Synthetic oligonucleotide
tcgtagcaccatcaataa

SEQ ID NO: 805 - DNA, 17 bp, Artificial Sequence
  Description of Artificial Sequence: Synthetic oligonucleotide
tccgggtcccccctcca

SEQ ID NO: 806 - DNA, 20 bp, Artificial Sequence
  Description of Artificial Sequence: Synthetic oligonucleotide
tccggggctgcacgcgcgct

SEQ ID NO: 807 - DNA, 15 bp, Artificial Sequence
  Description of Artificial Sequence: Synthetic oligonucleotide
tccggccgtgtcggt

SEQ ID NO: 808 - DNA, 18 bp, Artificial Sequence
  Description of Artificial Sequence: Synthetic oligonucleotide
tccctgtcctccaggagt

SEQ ID NO: 809 - DNA, 17 bp, Artificial Sequence
  Description of Artificial Sequence: Synthetic oligonucleotide
tcccctcctcgtcgcca

SEQ ID NO: 810 - DNA, 19 bp, Artificial Sequence
  Description of Artificial Sequence: Synthetic oligonucleotide
tcccaggtagtctagtggt

SEQ ID NO: 811 - DNA, 22 bp, Artificial Sequence
  Description of Artificial Sequence: Synthetic oligonucleotide
tattcatttatccccagcctat

SEQ ID NO: 812 - DNA, 17 bp, Artificial Sequence
  Description of Artificial Sequence: Synthetic oligonucleotide
tagttgttataacccaa

SEQ ID NO: 813 - DNA, 17 bp, Artificial Sequence
  Description of Artificial Sequence: Synthetic oligonucleotide
tagatcaccccctcccc

SEQ ID NO: 814 - DNA, 17 bp, Artificial Sequence
  Description of Artificial Sequence: Synthetic oligonucleotide
taccggcacctggcgcc

SEQ ID NO: 815 - DNA, 17 bp, Artificial Sequence
  Description of Artificial Sequence: Synthetic oligonucleotide
gtataggggcgaaagac

SEQ ID NO: 816 - DNA, 19 bp, Artificial Sequence
  Description of Artificial Sequence: Synthetic oligonucleotide
gtagctggttccctccgaa

SEQ ID NO: 817 - DNA, 17 bp, Artificial Sequence
  Description of Artificial Sequence: Synthetic oligonucleotide
ggtaagaagcccggctc

SEQ ID NO: 818 - DNA, 19 bp, Artificial Sequence
  Description of Artificial Sequence: Synthetic oligonucleotide
gggggggtttaaaaaaaaa

SEQ ID NO: 819 - DNA, 17 bp, Artificial Sequence
  Description of Artificial Sequence: Synthetic oligonucleotide
ggggcgcactaccggcc

SEQ ID NO: 820 - DNA, 19 bp, Artificial Sequence
  Description of Artificial Sequence: Synthetic oligonucleotide
gggagaggctgtcgctgcg

SEQ ID NO: 821 - DNA, 16 bp, Artificial Sequence
  Description of Artificial Sequence: Synthetic oligonucleotide
ggcgggtgaagcggcg

SEQ ID NO: 822 - DNA, 17 bp, Artificial Sequence
  Description of Artificial Sequence: Synthetic oligonucleotide
gcggttccggcggcgtc

SEQ ID NO: 823 - DNA, 24 bp, Artificial Sequence
  Description of Artificial Sequence: Synthetic oligonucleotide
gcggggcgcctaggcctggtttgt

SEQ ID NO: 824 - DNA, 22 bp, Artificial Sequence
  Description of Artificial Sequence: Synthetic oligonucleotide
gcggcggtcggcgggcggcggg

SEQ ID NO: 825 - DNA, 21 bp, Artificial Sequence
  Description of Artificial Sequence: Synthetic oligonucleotide
gagggggggggtgggggggga

SEQ ID NO: 826 - DNA, 17 bp, Artificial Sequence
  Description of Artificial Sequence: Synthetic oligonucleotide
ctgtcggccaccatcat

SEQ ID NO: 827 - DNA, 16 bp, Artificial Sequence
  Description of Artificial Sequence: Synthetic oligonucleotide
ctgcaactcgacccca

SEQ ID NO: 828 - DNA, 19 bp, Artificial Sequence
  Description of Artificial Sequence: Synthetic oligonucleotide
ctcctctccccgcccgccg

SEQ ID NO: 829 - DNA, 26 bp, Artificial Sequence
  Description of Artificial Sequence: Synthetic oligonucleotide
ctcaaagattaagccatgcatgtcta

SEQ ID NO: 830 - DNA, 15 bp, Artificial Sequence
  Description of Artificial Sequence: Synthetic oligonucleotide
ctacgccgcgacgag

SEQ ID NO: 831 - DNA, 22 bp, Artificial Sequence
  Description of Artificial Sequence: Synthetic oligonucleotide
cgggtgacggggaatcagggtt

SEQ ID NO: 832 - DNA, 16 bp, Artificial Sequence
  Description of Artificial Sequence: Synthetic oligonucleotide
cgggcagcttccggga

SEQ ID NO: 833 - DNA, 18 bp, Artificial Sequence
  Description of Artificial Sequence: Synthetic oligonucleotide
cgggaggcccgggtcctg

SEQ ID NO: 834 - DNA, 17 bp, Artificial Sequence
  Description of Artificial Sequence: Synthetic oligonucleotide
cggccccgcatcctccc

SEQ ID NO: 835 - DNA, 26 bp, Artificial Sequence
  Description of Artificial Sequence: Synthetic oligonucleotide
cgcgggtaaacggcgggagtaactat

SEQ ID NO: 836 - DNA, 20 bp, Artificial Sequence
  Description of Artificial Sequence: Synthetic oligonucleotide
cgccccccgttcccccctcc

SEQ ID NO: 837 - DNA, 15 bp, Artificial Sequence
  Description of Artificial Sequence: Synthetic oligonucleotide
cgagcggaaacacca

SEQ ID NO: 838 - DNA, 15 bp, Artificial Sequence
  Description of Artificial Sequence: Synthetic oligonucleotide
cgaacccggcaccgc

SEQ ID NO: 839 - DNA, 17 bp, Artificial Sequence
  Description of Artificial Sequence: Synthetic oligonucleotide
cctcgggccgatcgcac

SEQ ID NO: 840 - DNA, 16 bp, Artificial Sequence
  Description of Artificial Sequence: Synthetic oligonucleotide
cctatatatcttacca

SEQ ID NO: 841 - DNA, 17 bp, Artificial Sequence
  Description of Artificial Sequence: Synthetic oligonucleotide
ccgtggcggcgacgacc

SEQ ID NO: 842 - DNA, 16 bp, Artificial Sequence
  Description of Artificial Sequence: Synthetic oligonucleotide
ccgggttccggcacca

SEQ ID NO: 843 - DNA, 16 bp, Artificial Sequence
  Description of Artificial Sequence: Synthetic oligonucleotide
ccgcgaggggggcccg

SEQ ID NO: 844 - DNA, 16 bp, Artificial Sequence
  Description of Artificial Sequence: Synthetic oligonucleotide
ccgcctcacgggacca

SEQ ID NO: 845 - DNA, 20 bp, Artificial Sequence
  Description of Artificial Sequence: Synthetic oligonucleotide
ccgcccgtccccgccccttg

SEQ ID NO: 846 - DNA, 18 bp, Artificial Sequence
  Description of Artificial Sequence: Synthetic oligonucleotide
cccggggccgcggttccg

SEQ ID NO: 847 - DNA, 16 bp, Artificial Sequence
  Description of Artificial Sequence: Synthetic oligonucleotide
cccgagccgcctggat

SEQ ID NO: 848 - DNA, 15 bp, Artificial Sequence
  Description of Artificial Sequence: Synthetic oligonucleotide
cccgacggccgaact

SEQ ID NO: 849 - DNA, 19 bp, Artificial Sequence
  Description of Artificial Sequence: Synthetic oligonucleotide
ccccggggagcccggcggg

SEQ ID NO: 850 - DNA, 19 bp, Artificial Sequence
  Description of Artificial Sequence: Synthetic oligonucleotide
ccccctcgcggccctcccc

SEQ ID NO: 851 - DNA, 17 bp, Artificial Sequence
  Description of Artificial Sequence: Synthetic oligonucleotide
ccccccgtggcggcgac

SEQ ID NO: 852 - DNA, 17 bp, Artificial Sequence
  Description of Artificial Sequence: Synthetic oligonucleotide
ccacccagggcacgcca

SEQ ID NO: 853 - DNA, 16 bp, Artificial Sequence
  Description of Artificial Sequence: Synthetic oligonucleotide
cacgggtgacggggaa

SEQ ID NO: 854 - DNA, 23 bp, Artificial Sequence
  Description of Artificial Sequence: Synthetic oligonucleotide
atggggaggaaaaaaaaaaaaaa

SEQ ID NO: 855 - DNA, 18 bp, Artificial Sequence
  Description of Artificial Sequence: Synthetic oligonucleotide
atcccaccgctgccccca

SEQ ID NO: 856 - DNA, 16 bp, Artificial Sequence
  Description of Artificial Sequence: Synthetic oligonucleotide
atcacgtcggtcacca

SEQ ID NO: 857 - DNA, 23 bp, Artificial Sequence
  Description of Artificial Sequence: Synthetic oligonucleotide
acgggaaacctcacccggcccgg

SEQ ID NO: 858 - DNA, 24 bp, Artificial Sequence
  Description of Artificial Sequence: Synthetic oligonucleotide
acagaggcttacgaccccttattt

SEQ ID NO: 859 - DNA, 20 bp, Artificial Sequence
  Description of Artificial Sequence: Synthetic oligonucleotide
aaaaaggcataattaaactt

SEQ ID NO: 860 - DNA, 23 bp, Artificial Sequence
  Description of Artificial Sequence: Synthetic oligonucleotide
tggctcagttcagcaggaacagt

SEQ ID NO: 861 - DNA, 19 bp, Artificial Sequence
  Description of Artificial Sequence: Synthetic oligonucleotide
gtgggggagaggctgtcga

SEQ ID NO: 862 - DNA, 22 bp, Artificial Sequence
  Description of Artificial Sequence: Synthetic oligonucleotide
cggggcagctcagtacaggatt

SEQ ID NO: 863 - DNA, 23 bp, Artificial Sequence
  Description of Artificial Sequence: Synthetic oligonucleotide
aattgcacggtatccatctgtat

SEQ ID NO: 864 - DNA, 17 bp, Artificial Sequence
  Description of Artificial Sequence: Synthetic oligonucleotide
cgggggagcgccgcgta

SEQ ID NO: 865 - DNA, 22 bp, Artificial Sequence
  Description of Artificial Sequence: Synthetic oligonucleotide
tcgatcccgggtttcggcacca

SEQ ID NO: 866 - DNA, 23 bp, Artificial Sequence
  Description of Artificial Sequence: Synthetic oligonucleotide
atcgtatcccacttctgacacca

SEQ ID NO: 867 - DNA, 18 bp, Artificial Sequence
  Description of Artificial Sequence: Synthetic oligonucleotide
atcctgccgactacgcca

SEQ ID NO: 868 - DNA, 22 bp, Artificial Sequence
  Description of Artificial Sequence: Synthetic oligonucleotide
tcgaatcccactcctgacacca

SEQ ID NO: 869 - DNA, 18 bp, Artificial Sequence
  Description of Artificial Sequence: Synthetic oligonucleotide
atcccatcctcgtcgcca

SEQ ID NO: 870 - DNA, 22 bp, Artificial Sequence
  Description of Artificial Sequence: Synthetic oligonucleotide
tcgattccccgacggggagcca

SEQ ID NO: 871 - DNA, 18 bp, Artificial Sequence
  Description of Artificial Sequence: Synthetic oligonucleotide
atccgggtgccccctcca

SEQ ID NO: 872 - DNA, 17 bp, Artificial Sequence
  Description of Artificial Sequence: Synthetic oligonucleotide
tcccgggcggcgcacca

SEQ ID NO: 873 - DNA, 18 bp, Artificial Sequence
  Description of Artificial Sequence: Synthetic oligonucleotide
atcccaccagagtcgcca

SEQ ID NO: 874 - DNA, 22 bp, Artificial Sequence
  Description of Artificial Sequence: Synthetic oligonucleotide
tcaaatcacgtcggggtcacca

SEQ ID NO: 875 - DNA, 23 bp, Artificial Sequence
  Description of Artificial Sequence: Synthetic oligonucleotide
tgtcagtttgttaattgacccaa

SEQ ID NO: 876 - DNA, 22 bp, Artificial Sequence
  Description of Artificial Sequence: Synthetic oligonucleotide
tcgatccccgtacgggccacca

SEQ ID NO: 877 - DNA, 22 bp, Artificial Sequence
  Description of Artificial Sequence: Synthetic oligonucleotide
tcgagcctcacctggagcacca

SEQ ID NO: 878 - DNA, 17 bp, Artificial Sequence
  Description of Artificial Sequence: Synthetic oligonucleotide
tccggctcgaaggacca

SEQ ID NO: 879 - DNA, 18 bp, Artificial Sequence
  Description of Artificial Sequence: Synthetic oligonucleotide
ggcaatacgagcaccctg

SEQ ID NO: 880 - DNA, 16 bp, Artificial Sequence
  Description of Artificial Sequence: Synthetic oligonucleotide
ccggggcgtctcgtac

SEQ ID NO: 881 - DNA, 16 bp, Artificial Sequence
  Description of Artificial Sequence: Synthetic oligonucleotide
agcggctgtgcacaaa

SEQ ID NO: 882 - DNA, 20 bp, Artificial Sequence
  Description of Artificial Sequence: Synthetic oligonucleotide
tgtcagtttgtttaatccaa

SEQ ID NO: 883 - DNA, 20 bp, Artificial Sequence
  Description of Artificial Sequence: Synthetic oligonucleotide
tgtcagtttgttattaccaa

SEQ ID NO: 884 - DNA, 19 bp, Artificial Sequence
  Description of Artificial Sequence: Synthetic oligonucleotide
tgtcaggcaccatcaataa

SEQ ID NO: 885 - DNA, 20 bp, Artificial Sequence
  Description of Artificial Sequence: Synthetic oligonucleotide
tgatcttgacacttaaagcc

SEQ ID NO: 886 - DNA, 17 bp, Artificial Sequence
  Description of Artificial Sequence: Synthetic oligonucleotide
tcgtaggcaccatcaat

SEQ ID NO: 887 - DNA, 22 bp, Artificial Sequence
  Description of Artificial Sequence: Synthetic oligonucleotide
tcgactcccggtatgggaacca

SEQ ID NO: 888 - DNA, 23 bp, Artificial Sequence
  Description of Artificial Sequence: Synthetic oligonucleotide
tagggaggttatgattaactttt

SEQ ID NO: 889 - DNA, 20 bp, Artificial Sequence
  Description of Artificial Sequence: Synthetic oligonucleotide
taaagtgcttagtgcaggta

SEQ ID NO: 890 - DNA, 19 bp, Artificial Sequence
  Description of Artificial Sequence: Synthetic oligonucleotide
gtttatgttgcttacctcc

SEQ ID NO: 891 - DNA, 18 bp, Artificial Sequence
  Description of Artificial Sequence: Synthetic oligonucleotide
gtagataaaatattggcg

SEQ ID NO: 892 - DNA, 17 bp, Artificial Sequence
  Description of Artificial Sequence: Synthetic oligonucleotide
ggcggggacgacgtcag

SEQ ID NO: 893 - DNA, 19 bp, Artificial Sequence
  Description of Artificial Sequence: Synthetic oligonucleotide
ggcggcgtcgcggcgggtc

SEQ ID NO: 894 - DNA, 24 bp, Artificial Sequence
  Description of Artificial Sequence: Synthetic oligonucleotide
ggagggggtgaacaaaaagaaaaa

SEQ ID NO: 895 - DNA, 29 bp, Artificial Sequence
  Description of Artificial Sequence: Synthetic oligonucleotide
gctaaacctagccccaaacccactccaca

SEQ ID NO: 896 - DNA, 19 bp, Artificial Sequence
  Description of Artificial Sequence: Synthetic oligonucleotide
ctggatagcgcacttcgtt

SEQ ID NO: 897 - DNA, 21 bp, Artificial Sequence
  Description of Artificial Sequence: Synthetic oligonucleotide
cgggcgaggggcggacgttcg

SEQ ID NO: 898 - DNA, 15 bp, Artificial Sequence
  Description of Artificial Sequence: Synthetic oligonucleotide
cggacctataccgga

SEQ ID NO: 899 - DNA, 30 bp, Artificial Sequence; identical to SEQ ID NO: 679
  Description of Artificial Sequence: Synthetic oligonucleotide

SEQ ID NO: 900 - DNA, 17 bp, Artificial Sequence
  Description of Artificial Sequence: Synthetic oligonucleotide
ccccccacaaccgcgaa

SEQ ID NO: 901 - DNA, 20 bp, Artificial Sequence
  Description of Artificial Sequence: Synthetic oligonucleotide
cccagcatctcctgtgttta

SEQ ID NO: 902 - DNA, 17 bp, Artificial Sequence
  Description of Artificial Sequence: Synthetic oligonucleotide
cccacgttgggacgcca

SEQ ID NO: 903 - DNA, 18 bp, Artificial Sequence
  Description of Artificial Sequence: Synthetic oligonucleotide
atcacgtccgtgcctcca

SEQ ID NO: 904 - DNA, 21 bp, Artificial Sequence
  Description of Artificial Sequence: Synthetic oligonucleotide
atagcaatgtcagcagtacct

SEQ ID NO: 905 - DNA, 18 bp, Artificial Sequence
  Description of Artificial Sequence: Synthetic oligonucleotide
accctgctcgctgcgcca

SEQ ID NO: 906 - DNA, 18 bp, Artificial Sequence
  Description of Artificial Sequence: Synthetic oligonucleotide
tcccacccagggacgcca

SEQ ID NO: 907 - DNA, 17 bp, Artificial Sequence
  Description of Artificial Sequence: Synthetic oligonucleotide
tcgtaggcacatcaata

SEQ ID NO: 908 - DNA, 16 bp, Artificial Sequence
  Description of Artificial Sequence: Synthetic oligonucleotide
cccccacaaccgcgta

SEQ ID NO: 909 - DNA, 18 bp, Artificial Sequence
  Description of Artificial Sequence: Synthetic oligonucleotide
accccgtccgtgcctcca

SEQ ID NO: 910 - DNA, 19 bp, Artificial Sequence
  Description of Artificial Sequence: Synthetic oligonucleotide
aaaaaagacaccccccaca

SEQ ID NO: 911 - DNA, 19 bp, Artificial Sequence
  Description of Artificial Sequence: Synthetic oligonucleotide
tgtcagtttgttaacccaa

SEQ ID NO: 912 - DNA, 22 bp, Artificial Sequence
  Description of Artificial Sequence: Synthetic oligonucleotide
tccctgtggtctagtggttagg

SEQ ID NO: 913 - DNA, 15 bp, Artificial Sequence
  Description of Artificial Sequence: Synthetic oligonucleotide
gggggggtaaaaaaa

SEQ ID NO: 914 - DNA, 16 bp, Artificial Sequence
  Description of Artificial Sequence: Synthetic oligonucleotide
ggggggggaaaaaaaa

SEQ ID NO: 915 - DNA, 17 bp, Artificial Sequence
  Description of Artificial Sequence: Synthetic oligonucleotide
cgggcccgggtcttccc

SEQ ID NO: 916 - DNA, 19 bp, Artificial Sequence
  Description of Artificial Sequence: Synthetic oligonucleotide
ccgccccccgttcccccca

SEQ ID NO: 917 - DNA, 19 bp, Artificial Sequence
  Description of Artificial Sequence: Synthetic oligonucleotide
acccccggctcctccacca

SEQ ID NO: 918 - DNA, 19 bp, Artificial Sequence
  Description of Artificial Sequence: Synthetic oligonucleotide
tttggtggaaattttttga

SEQ ID NO: 919 - DNA, 19 bp, Artificial Sequence
  Description of Artificial Sequence: Synthetic oligonucleotide
tgtcagtttgttataccaa

SEQ ID NO: 920 - DNA, 22 bp, Artificial Sequence
  Description of Artificial Sequence: Synthetic oligonucleotide
tgtcagtttgtaattatcccaa

SEQ ID NO: 921 - DNA, 18 bp, Artificial Sequence
  Description of Artificial Sequence: Synthetic oligonucleotide
tgtcaatttttaacccaa

SEQ ID NO: 922 - DNA, 19 bp, Artificial Sequence
  Description of Artificial Sequence: Synthetic oligonucleotide
tgctagggtaaaaaaaaaa

SEQ ID NO: 923 - DNA, 23 bp, Artificial Sequence
  Description of Artificial Sequence: Synthetic oligonucleotide
tgcaactccaaataaaagtacca

SEQ ID NO: 924 - DNA, 18 bp, Artificial Sequence
  Description of Artificial Sequence: Synthetic oligonucleotide
tgaggtaacggggaatta

SEQ ID NO: 925 - DNA, 18 bp, Artificial Sequence
  Description of Artificial Sequence: Synthetic oligonucleotide
tcctcggcatctccacca

SEQ ID NO: 926 - DNA, 24 bp, Artificial Sequence
  Description of Artificial Sequence: Synthetic oligonucleotide
tcatatgaagtcaccctagccatc

SEQ ID NO: 927 - DNA, 21 bp, Artificial Sequence
  Description of Artificial Sequence: Synthetic oligonucleotide
tcagtttgtttattaacccaa

SEQ ID NO: 928 - DNA, 18 bp, Artificial Sequence
  Description of Artificial Sequence: Synthetic oligonucleotide
tcagcgtgtctttgccct

SEQ ID NO: 929 - DNA, 19 bp, Artificial Sequence
  Description of Artificial Sequence: Synthetic oligonucleotide
tcactggtggtctagtggt

SEQ ID NO: 930 - DNA, 17 bp, Artificial Sequence
  Description of Artificial Sequence: Synthetic oligonucleotide
tcacaatgctgccacca

SEQ ID NO: 931 - DNA, 19 bp, Artificial Sequence
  Description of Artificial Sequence: Synthetic oligonucleotide
tagttgttaattaacccaa

SEQ ID NO: 932 - DNA, 18 bp, Artificial Sequence
  Description of Artificial Sequence: Synthetic oligonucleotide
tagtcctcatcgccctcc

SEQ ID NO: 933 - DNA, 23 bp, Artificial Sequence
  Description of Artificial Sequence: Synthetic oligonucleotide
taaagtgcttatagtgcgggtaa

SEQ ID NO: 934 - DNA, 18 bp, Artificial Sequence
  Description of Artificial Sequence: Synthetic oligonucleotide
gtcccaccagagtcgcca

SEQ ID NO: 935 - DNA, 19 bp, Artificial Sequence
  Description of Artificial Sequence: Synthetic oligonucleotide
gggggaggggccaaaaaaa

SEQ ID NO: 936 - DNA, 17 bp, Artificial Sequence
  Description of Artificial Sequence: Synthetic oligonucleotide
gggacgccgcggtgtcg

SEQ ID NO: 937 - DNA, 24 bp, Artificial Sequence
  Description of Artificial Sequence: Synthetic oligonucleotide
gggaataccgggtgctttaggctt

SEQ ID NO: 938 - DNA, 19 bp, Artificial Sequence
  Description of Artificial Sequence: Synthetic oligonucleotide
ggaagaaggtggtggtata

SEQ ID NO: 939 - DNA, 15 bp, Artificial Sequence
  Description of Artificial Sequence: Synthetic oligonucleotide
gcggtgaaatgcgta

SEQ ID NO: 940 - DNA, 17 bp, Artificial Sequence
  Description of Artificial Sequence: Synthetic oligonucleotide
gcggggaaggtggcaaa

SEQ ID NO: 941 - DNA, 26 bp, Artificial Sequence
  Description of Artificial Sequence: Synthetic oligonucleotide
gcgacgacctcgcgcccacctggtca

SEQ ID NO: 942 - DNA, 18 bp, Artificial Sequence
  Description of Artificial Sequence: Synthetic oligonucleotide
gccacccgatactgctgt

SEQ ID NO: 943 - DNA, 21 bp, Artificial Sequence
  Description of Artificial Sequence: Synthetic oligonucleotide
gatgtatgctttgtttctgtt

SEQ ID NO: 944 - DNA, 20 bp, Artificial Sequence
  Description of Artificial Sequence: Synthetic oligonucleotide
gagggggatttagaaaaaaa

SEQ ID NO: 945 - DNA, 18 bp, Artificial Sequence
  Description of Artificial Sequence: Synthetic oligonucleotide
gaaggaaagttctatagt

SEQ ID NO: 946 - DNA, 18 bp, Artificial Sequence
  Description of Artificial Sequence: Synthetic oligonucleotide
gaagcggctctcttattt

SEQ ID NO: 947 - DNA, 22 bp, Artificial Sequence
  Description of Artificial Sequence: Synthetic oligonucleotide
gaacgagactctggcatgctga

SEQ ID NO: 948 - DNA, 17 bp, Artificial Sequence
  Description of Artificial Sequence: Synthetic oligonucleotide
ctggtaggcccatcaat

SEQ ID NO: 949 - DNA, 17 bp, Artificial Sequence
  Description of Artificial Sequence: Synthetic oligonucleotide
cggggccgatcgcgcgc

SEQ ID NO: 950 - DNA, 18 bp, Artificial Sequence
  Description of Artificial Sequence: Synthetic oligonucleotide
cggccccgggttcctccc

SEQ ID NO: 951 - DNA, 15 bp, Artificial Sequence
  Description of Artificial Sequence: Synthetic oligonucleotide
cgagcccggttagta

SEQ ID NO: 952 - DNA, 17 bp, Artificial Sequence
  Description of Artificial Sequence: Synthetic oligonucleotide
cgactcttagcggtgga

SEQ ID NO: 953 - DNA, 21 bp, Artificial Sequence
  Description of Artificial Sequence: Synthetic oligonucleotide
cgaatcccacttctgacacca

SEQ ID NO: 954 - DNA, 17 bp, Artificial Sequence
  Description of Artificial Sequence: Synthetic oligonucleotide
cgaaagggaatcgggtc

SEQ ID NO: 955 - DNA, 18 bp, Artificial Sequence
  Description of Artificial Sequence: Synthetic oligonucleotide
ccttaggtcgctggtaaa

SEQ ID NO: 956 - DNA, 16 bp, Artificial Sequence
  Description of Artificial Sequence: Synthetic oligonucleotide
ccgtgcgagaatacca

SEQ ID NO: 957 - DNA, 18 bp, Artificial Sequence
  Description of Artificial Sequence: Synthetic oligonucleotide
ccggtctctcaagcggcc

SEQ ID NO: 958 - DNA, 18 bp, Artificial Sequence
  Description of Artificial Sequence: Synthetic oligonucleotide
cccggccctcgcgcgtcc

SEQ ID NO: 959 - DNA, 17 bp, Artificial Sequence
  Description of Artificial Sequence: Synthetic oligonucleotide
ccccggcatttccacca

SEQ ID NO: 960 - DNA, 20 bp, Artificial Sequence
  Description of Artificial Sequence: Synthetic oligonucleotide
cccccccggctcctccacca

SEQ ID NO: 961 - DNA, 16 bp, Artificial Sequence
  Description of Artificial Sequence: Synthetic oligonucleotide
ccccccacaaccgcta

SEQ ID NO: 962 - DNA, 19 bp, Artificial Sequence
  Description of Artificial Sequence: Synthetic oligonucleotide
cccaagtattgactcaccc

SEQ ID NO: 963 - DNA, 16 bp, Artificial Sequence
  Description of Artificial Sequence: Synthetic oligonucleotide
ccagtaagcgcgagtc

SEQ ID NO: 964 - DNA, 19 bp, Artificial Sequence
  Description of Artificial Sequence: Synthetic oligonucleotide
ccaaagaaagcacgtagag

SEQ ID NO: 965 - DNA, 19 bp, Artificial Sequence
  Description of Artificial Sequence: Synthetic oligonucleotide
catgtttaacggccgcggt

SEQ ID NO: 966 - DNA, 19 bp, Artificial Sequence
  Description of Artificial Sequence: Synthetic oligonucleotide
cagtttgtaattaacccaa

SEQ ID NO: 967 - DNA, 16 bp, Artificial Sequence
  Description of Artificial Sequence: Synthetic oligonucleotide
caggaacggcgcacca

SEQ ID NO: 968 - DNA, 19 bp, Artificial Sequence
  Description of Artificial Sequence: Synthetic oligonucleotide
cagaaccctctaaatcccc

SEQ ID NO: 969 - DNA, 23 bp, Artificial Sequence
  Description of Artificial Sequence: Synthetic oligonucleotide
cacccggctgtgtgcacatgtgt

SEQ ID NO: 970 - DNA, 18 bp, Artificial Sequence
  Description of Artificial Sequence: Synthetic oligonucleotide
caattggaccaatctatc

SEQ ID NO: 971 - DNA, 17 bp, Artificial Sequence
  Description of Artificial Sequence: Synthetic oligonucleotide
attcctgtactgcgata

SEQ ID NO: 972 - DNA, 18 bp, Artificial Sequence
  Description of Artificial Sequence: Synthetic oligonucleotide
atccctgcggcgtctcca

SEQ ID NO: 973 - DNA, 18 bp, Artificial Sequence
  Description of Artificial Sequence: Synthetic oligonucleotide
atcccaccgctgccatca

SEQ ID NO: 974 - DNA, 20 bp, Artificial Sequence
  Description of Artificial Sequence: Synthetic oligonucleotide
agtcaatagaagccggcgta

SEQ ID NO: 975 - DNA, 17 bp, Artificial Sequence
  Description of Artificial Sequence: Synthetic oligonucleotide
aggttcgtttgtaaaaa

SEQ ID NO: 976 - DNA, 19 bp, Artificial Sequence
  Description of Artificial Sequence: Synthetic oligonucleotide
aggtcctgggtttaagtgt

SEQ ID NO: 977 - DNA, 19 bp, Artificial Sequence
  Description of Artificial Sequence: Synthetic oligonucleotide
agggggaagttctatagtc

SEQ ID NO: 978 - DNA, 25 bp, Artificial Sequence
  Description of Artificial Sequence: Synthetic oligonucleotide
  modified_base (17)..(17): a, c, t, g, unknown or other
aggctgtgatgctctcntgagccct

SEQ ID NO: 979 - DNA, 19 bp, Artificial Sequence
  Description of Artificial Sequence: Synthetic oligonucleotide
agcccctctccggccctta

SEQ ID NO: 980 - DNA, 17 bp, Artificial Sequence
  Description of Artificial Sequence: Synthetic oligonucleotide
actaccacctacctccc

SEQ ID NO: 981 - DNA, 21 bp, Artificial Sequence
  Description of Artificial Sequence: Synthetic oligonucleotide
acgcccttcccccccttcttt

SEQ ID NO: 982 - DNA, 18 bp, Artificial Sequence
  Description of Artificial Sequence: Synthetic oligonucleotide
accccactcctggtgcac

SEQ ID NO: 983 - DNA, 18 bp, Artificial Sequence
  Description of Artificial Sequence: Synthetic oligonucleotide
accacctgatcccttccc

SEQ ID NO: 984 - DNA, 18 bp, Artificial Sequence
  Description of Artificial Sequence: Synthetic oligonucleotide
acagctaagcacccacca

SEQ ID NO: 985 - DNA, 17 bp, Artificial Sequence
  Description of Artificial Sequence: Synthetic oligonucleotide
acacatgtttaacggcc

SEQ ID NO: 986 - DNA, 17 bp, Artificial Sequence
  Description of Artificial Sequence: Synthetic oligonucleotide
aattagggacctgtatg

SEQ ID NO: 987 - DNA, 21 bp, Artificial Sequence
  Description of Artificial Sequence: Synthetic oligonucleotide
aatggcccatttgggcaaaca

SEQ ID NO: 988 - DNA, 18 bp, Artificial Sequence
  Description of Artificial Sequence: Synthetic oligonucleotide
aaagcggctgtgcaaaca

SEQ ID NO: 989 - DNA, 22 bp, Artificial Sequence
  Description of Artificial Sequence: Synthetic oligonucleotide
tcgactcctggctggctcgcca

SEQ ID NO: 990 - DNA, 19 bp, Artificial Sequence
  Description of Artificial Sequence: Synthetic oligonucleotide
tccccggcatctccaccaa

SEQ ID NO: 991 - DNA, 25 bp, Artificial Sequence
  Description of Artificial Sequence: Synthetic oligonucleotide
gcggtggatcactcggctcgtgcgt

SEQ ID NO: 992 - DNA, 14 bp, Artificial Sequence
  Description of Artificial Sequence: Synthetic oligonucleotide
ccgggtgttgtaga

SEQ ID NO: 993 - DNA, 19 bp, Artificial Sequence
  Description of Artificial Sequence: Synthetic oligonucleotide
tgtagcgtggccgagcggt

SEQ ID NO: 994 - DNA, 19 bp, Artificial Sequence
  Description of Artificial Sequence: Synthetic oligonucleotide
tggggcgacctcggagcag

SEQ ID NO: 995 - DNA, 27 bp, Artificial Sequence
  Description of Artificial Sequence: Synthetic oligonucleotide
tggcgtcctaagccagggattgtgggt

SEQ ID NO: 996 - DNA, 23 bp, Artificial Sequence
  Description of Artificial Sequence: Synthetic oligonucleotide
tggcaggggagataccatgattt

SEQ ID NO: 997 - DNA, 19 bp, Artificial Sequence
  Description of Artificial Sequence: Synthetic oligonucleotide
tctgatcagggtgagcatc

SEQ ID NO: 998 - DNA, 17 bp, Artificial Sequence
  Description of Artificial Sequence: Synthetic oligonucleotide
tcgtaggcaccatccat

SEQ ID NO: 999 - DNA, 19 bp, Artificial Sequence
  Description of Artificial Sequence: Synthetic oligonucleotide
gggaaacggggcgcggctg

SEQ ID NO: 1000 - DNA, 24 bp, Artificial Sequence
  Description of Artificial Sequence: Synthetic oligonucleotide
ctactcctgctcgcatctgctata

SEQ ID NO: 1001 - DNA, 18 bp, Artificial Sequence
  Description of Artificial Sequence: Synthetic oligonucleotide
cgggtgggtttttaccgg

SEQ ID NO: 1002 - DNA, 18 bp, Artificial Sequence
  Description of Artificial Sequence: Synthetic oligonucleotide
cgaggaattcccagtaag

SEQ ID NO: 1003 - DNA, 19 bp, Artificial Sequence
  Description of Artificial Sequence: Synthetic oligonucleotide
cgaacgcacttgcggcccc

SEQ ID NO: 1004 - DNA, 19 bp, Artificial Sequence
  Description of Artificial Sequence: Synthetic oligonucleotide
ccccgcgcgggttcgaatc

SEQ ID NO: 1005 - DNA, 19 bp, Artificial Sequence
  Description of Artificial Sequence: Synthetic oligonucleotide
aggggtatgattcccgctt

SEQ ID NO: 1006 - DNA, 18 bp, Artificial Sequence
  Description of Artificial Sequence: Synthetic oligonucleotide
cggggccacgcgcgcgtc

SEQ ID NO: 1007 - DNA, 18 bp, Artificial Sequence
  Description of Artificial Sequence: Synthetic oligonucleotide
tggcgctgcgggatgaac

SEQ ID NO: 1008 - DNA, 27 bp, Artificial Sequence
  Description of Artificial Sequence: Synthetic oligonucleotide
ccccccactgctaaatttgactggctt

SEQ ID NO: 1009 - DNA, 19 bp, Artificial Sequence
  Description of Artificial Sequence: Synthetic oligonucleotide
taaaggttcgtttgtaaaa

SEQ ID NO: 1010 - DNA, 17 bp, Artificial Sequence
  Description of Artificial Sequence: Synthetic oligonucleotide
cggggccgagggagcga

SEQ ID NO: 1011 - DNA, 16 bp, Artificial Sequence
  Description of Artificial Sequence: Synthetic oligonucleotide
gggttaggcctctttt

SEQ ID NO: 1012 - DNA, 17 bp, Artificial Sequence
  Description of Artificial Sequence: Synthetic oligonucleotide
ctgcggaaggatcatta

SEQ ID NO: 1013 - DNA, 14 bp, Artificial Sequence
  Description of Artificial Sequence: Synthetic oligonucleotide
ccctacccccccgg

SEQ ID NO: 1014 - DNA, 16 bp, Artificial Sequence
  Description of Artificial Sequence: Synthetic oligonucleotide
cccgccgggtccgccc

SEQ ID NO: 1015 - DNA, 20 bp, Artificial Sequence
  Description of Artificial Sequence: Synthetic oligonucleotide
ccccgcgccctctctctctc

SEQ ID NO: 1016 - DNA, 17 bp, Artificial Sequence
  Description of Artificial Sequence: Synthetic oligonucleotide
caggcctccctggaatc

SEQ ID NO: 1017 - DNA, 19 bp, Artificial Sequence
  Description of Artificial Sequence: Synthetic oligonucleotide
agtcccacccggggtacca

SEQ ID NO: 1018 - DNA, 22 bp, Artificial Sequence
  Description of Artificial Sequence: Synthetic oligonucleotide
ttgacacgccccagtgccctgt

SEQ ID NO: 1019 - DNA, 19 bp, Artificial Sequence
  Description of Artificial Sequence: Synthetic oligonucleotide
tgggagcgggcgggcggtc

SEQ ID NO: 1020 - DNA, 18 bp, Artificial Sequence
  Description of Artificial Sequence: Synthetic oligonucleotide
tggcgtggagccgggcgt

SEQ ID NO: 1021 - DNA, 17 bp, Artificial Sequence
  Description of Artificial Sequence: Synthetic oligonucleotide
tggaggtccgtagcggt

SEQ ID NO: 1022 - DNA, 18 bp, Artificial Sequence
  Description of Artificial Sequence: Synthetic oligonucleotide
tgaagaaggtctcgaaca

SEQ ID NO: 1023 - DNA, 17 bp, Artificial Sequence
  Description of Artificial Sequence: Synthetic oligonucleotide
tctcgccggggcttcca

SEQ ID NO: 1024 - DNA, 18 bp, Artificial Sequence
  Description of Artificial Sequence: Synthetic oligonucleotide
tcgtagcaccatcaataa

SEQ ID NO: 1025 - DNA, 17 bp, Artificial Sequence
  Description of Artificial Sequence: Synthetic oligonucleotide
tccgggtcccccctcca

SEQ ID NO: 1026 - DNA, 20 bp, Artificial Sequence
  Description of Artificial Sequence: Synthetic oligonucleotide
tccggggctgcacgcgcgct

SEQ ID NO: 1027 - DNA, 15 bp, Artificial Sequence
  Description of Artificial Sequence: Synthetic oligonucleotide
tccggccgtgtcggt

SEQ ID NO: 1028 - DNA, 18 bp, Artificial Sequence
  Description of Artificial Sequence: Synthetic oligonucleotide
tccctgtcctccaggagt

SEQ ID NO: 1029 - DNA, 17 bp, Artificial Sequence
  Description of Artificial Sequence: Synthetic oligonucleotide
tcccctcctcgtcgcca

SEQ ID NO: 1030 - DNA, 19 bp, Artificial Sequence
  Description of Artificial Sequence: Synthetic oligonucleotide
tcccaggtagtctagtggt

SEQ ID NO: 1031 - DNA, 22 bp, Artificial Sequence
  Description of Artificial Sequence: Synthetic oligonucleotide
tattcatttatccccagcctat

SEQ ID NO: 1032 - DNA, 17 bp, Artificial Sequence
  Description of Artificial Sequence: Synthetic oligonucleotide
tagttgttataacccaa

SEQ ID NO: 1033 - DNA, 17 bp, Artificial Sequence
  Description of Artificial Sequence: Synthetic oligonucleotide
tagatcaccccctcccc

SEQ ID NO: 1034 - DNA, 17 bp, Artificial Sequence
  Description of Artificial Sequence: Synthetic oligonucleotide
taccggcacctggcgcc

SEQ ID NO: 1035 - DNA, 17 bp, Artificial Sequence
  Description of Artificial Sequence: Synthetic oligonucleotide
gtataggggcgaaagac

SEQ ID NO: 1036 - DNA, 19 bp, Artificial Sequence
  Description of Artificial Sequence: Synthetic oligonucleotide
gtagctggttccctccgaa

SEQ ID NO: 1037 - DNA, 17 bp, Artificial Sequence
  Description of Artificial Sequence: Synthetic oligonucleotide
ggtaagaagcccggctc

SEQ ID NO: 1038 - DNA, 19 bp, Artificial Sequence
  Description of Artificial Sequence: Synthetic oligonucleotide
gggggggtttaaaaaaaaa

SEQ ID NO: 1039 - DNA, 17 bp, Artificial Sequence
  Description of Artificial Sequence: Synthetic oligonucleotide
ggggcgcactaccggcc

SEQ ID NO: 1040 - DNA, 19 bp, Artificial Sequence
  Description of Artificial Sequence: Synthetic oligonucleotide
gggagaggctgtcgctgcg

SEQ ID NO: 1041 - DNA, 16 bp, Artificial Sequence
  Description of Artificial Sequence: Synthetic oligonucleotide
ggcgggtgaagcggcg

SEQ ID NO: 1042 - DNA, 17 bp, Artificial Sequence
  Description of Artificial Sequence: Synthetic oligonucleotide
gcggttccggcggcgtc

SEQ ID NO: 1043 - DNA, 24 bp, Artificial Sequence
  Description of Artificial Sequence: Synthetic oligonucleotide
gcggggcgcctaggcctggtttgt

SEQ ID NO: 1044 - DNA, 22 bp, Artificial Sequence
  Description of Artificial Sequence: Synthetic oligonucleotide
gcggcggtcggcgggcggcggg

SEQ ID NO: 1045 - DNA, 21 bp, Artificial Sequence
  Description of Artificial Sequence: Synthetic oligonucleotide
gagggggggggtgggggggga

SEQ ID NO: 1046 - DNA, 17 bp, Artificial Sequence
  Description of Artificial Sequence: Synthetic oligonucleotide
ctgtcggccaccatcat

SEQ ID NO: 1047 - DNA, 16 bp, Artificial Sequence
  Description of Artificial Sequence: Synthetic oligonucleotide
ctgcaactcgacccca

SEQ ID NO: 1048 - DNA, 19 bp, Artificial Sequence
  Description of Artificial Sequence: Synthetic oligonucleotide
ctcctctccccgcccgccg

SEQ ID NO: 1049 - DNA, 26 bp, Artificial Sequence
  Description of Artificial Sequence: Synthetic oligonucleotide
ctcaaagattaagccatgcatgtcta

SEQ ID NO: 1050 - DNA, 15 bp, Artificial Sequence
  Description of Artificial Sequence: Synthetic oligonucleotide
ctacgccgcgacgag

SEQ ID NO: 1051 - DNA, 22 bp, Artificial Sequence
  Description of Artificial Sequence: Synthetic oligonucleotide
cgggtgacggggaatcagggtt

SEQ ID NO: 1052 - DNA, 16 bp, Artificial Sequence
  Description of Artificial Sequence: Synthetic oligonucleotide
cgggcagcttccggga

SEQ ID NO: 1053 - DNA, 18 bp, Artificial Sequence
  Description of Artificial Sequence: Synthetic oligonucleotide
cgggaggcccgggtcctg

SEQ ID NO: 1054 - DNA, 17 bp, Artificial Sequence
  Description of Artificial Sequence: Synthetic oligonucleotide
cggccccgcatcctccc

SEQ ID NO: 1055 - DNA, 26 bp, Artificial Sequence
  Description of Artificial Sequence: Synthetic oligonucleotide
cgcgggtaaacggcgggagtaactat

SEQ ID NO: 1056 - DNA, 20 bp, Artificial Sequence
  Description of Artificial Sequence: Synthetic oligonucleotide
cgccccccgttcccccctcc

SEQ ID NO: 1057 - DNA, 15 bp, Artificial Sequence
  Description of Artificial Sequence: Synthetic oligonucleotide
cgagcggaaacacca

SEQ ID NO: 1058 - DNA, 15 bp, Artificial Sequence
  Description of Artificial Sequence: Synthetic oligonucleotide
cgaacccggcaccgc

SEQ ID NO: 1059 - DNA, 17 bp, Artificial Sequence
  Description of Artificial Sequence: Synthetic oligonucleotide
cctcgggccgatcgcac

SEQ ID NO: 1060 - DNA, 16 bp, Artificial Sequence
  Description of Artificial Sequence: Synthetic oligonucleotide
cctatatatcttacca

SEQ ID NO: 1061 - DNA, 17 bp, Artificial Sequence
  Description of Artificial Sequence: Synthetic oligonucleotide
ccgtggcggcgacgacc

SEQ ID NO: 1062 - DNA, 16 bp, Artificial Sequence
  Description of Artificial Sequence: Synthetic oligonucleotide
ccgggttccggcacca

SEQ ID NO: 1063 - DNA, 16 bp, Artificial Sequence
  Description of Artificial Sequence: Synthetic oligonucleotide
ccgcgaggggggcccg

SEQ ID NO: 1064 - DNA, 16 bp, Artificial Sequence
  Description of Artificial Sequence: Synthetic oligonucleotide
ccgcctcacgggacca

SEQ ID NO: 1065 - DNA, 20 bp, Artificial Sequence
  Description of Artificial Sequence: Synthetic oligonucleotide
ccgcccgtccccgccccttg

SEQ ID NO: 1066 - DNA, 18 bp, Artificial Sequence
  Description of Artificial Sequence: Synthetic oligonucleotide
cccggggccgcggttccg

SEQ ID NO: 1067 - DNA, 16 bp, Artificial Sequence
  Description of Artificial Sequence: Synthetic oligonucleotide
cccgagccgcctggat

SEQ ID NO: 1068 - DNA, 15 bp, Artificial Sequence
  Description of Artificial Sequence: Synthetic oligonucleotide
cccgacggccgaact

SEQ ID NO: 1069 - DNA, 19 bp, Artificial Sequence
  Description of Artificial Sequence: Synthetic oligonucleotide
ccccggggagcccggcggg

SEQ ID NO: 1070 - DNA, 19 bp, Artificial Sequence
  Description of Artificial Sequence: Synthetic oligonucleotide
ccccctcgcggccctcccc

SEQ ID NO: 1071 - DNA, 17 bp, Artificial Sequence
  Description of Artificial Sequence: Synthetic oligonucleotide
ccccccgtggcggcgac

SEQ ID NO: 1072 - DNA, 17 bp, Artificial Sequence
  Description of Artificial Sequence: Synthetic oligonucleotide
ccacccagggcacgcca

SEQ ID NO: 1073 - DNA, 16 bp, Artificial Sequence
  Description of Artificial Sequence: Synthetic oligonucleotide
cacgggtgacggggaa

SEQ ID NO: 1074 - DNA, 23 bp, Artificial Sequence
  Description of Artificial Sequence: Synthetic oligonucleotide
atggggaggaaaaaaaaaaaaaa

SEQ ID NO: 1075 - DNA, 18 bp, Artificial Sequence
  Description of Artificial Sequence: Synthetic oligonucleotide
atcccaccgctgccccca

SEQ ID NO: 1076 - DNA, 16 bp, Artificial Sequence
  Description of Artificial Sequence: Synthetic oligonucleotide
atcacgtcggtcacca

SEQ ID NO: 1077 - DNA, 23 bp, Artificial Sequence
  Description of Artificial Sequence: Synthetic oligonucleotide
acgggaaacctcacccggcccgg

SEQ ID NO: 1078 - DNA, 24 bp, Artificial Sequence
  Description of Artificial Sequence: Synthetic oligonucleotide
acagaggcttacgaccccttattt

SEQ ID NO: 1079 - DNA, 20 bp, Artificial Sequence
  Description of Artificial Sequence: Synthetic oligonucleotide
aaaaaggcataattaaactt

SEQ ID NO: 1080 - DNA, 18 bp, Artificial Sequence
  Description of Artificial Sequence: Synthetic probe
tggtgtcagaagtgggat

SEQ ID NO: 1081 - DNA, 22 bp, Artificial Sequence
  Description of Artificial Sequence: Synthetic probe
tctaccactgaaccaccaatgc

SEQ ID NO: 1082 - DNA, 20 bp, Artificial Sequence
  Description of Artificial Sequence: Synthetic probe
aaaaatatggaacgcttcac

SEQ ID NO: 1083 - DNA, 27 bp, Artificial Sequence
  Description of Artificial Sequence: Synthetic probe
gctcagactccagttcgcatcacccgc

SEQ ID NO: 1084 - DNA, 18 bp, Artificial Sequence
  Description of Artificial Sequence: Synthetic probe
tggtgtcaggagtgggat

SEQ ID NO: 1085 - DNA, 22 bp, Artificial Sequence
  Description of Artificial Sequence: Synthetic probe
tggtgcattggccgggaatcga

SEQ ID NO: 1086 - DNA, 20 bp, Artificial Sequence
  Description of Artificial Sequence: Synthetic probe
aaccactcggccacctcgtc

SEQ ID NO: 1087 - DNA, 18 bp, Artificial Sequence
  Description of Artificial Sequence: Synthetic probe
tggtggaggtgccgggga

SEQ ID NO: 1088 - DNA, 26 bp, Artificial Sequence
  Description of Artificial Sequence: Synthetic probe
aaaactgagcacaggacttccttagc

SEQ ID NO: 1089 - DNA, 27 bp, Artificial Sequence
  Description of Artificial Sequence: Synthetic probe
aagccagtcaaatttagcagtgggggg

SEQ ID NO: 1090 - DNA, 19 bp, Artificial Sequence
  Description of Artificial Sequence: Synthetic probe
tggcgacccagatgggact

SEQ ID NO: 1091 - DNA, 23 bp, Artificial Sequence
  Description of Artificial Sequence: Synthetic probe
ctcactcagacatccaaggaagg

SEQ ID NO: 1092 - DNA, 22 bp, Artificial Sequence
  Description of Artificial Sequence: Synthetic probe
tggtgcatgggccgggaatcga

SEQ ID NO: 1093 - DNA, 24 bp, Artificial Sequence
  Description of Artificial Sequence: Synthetic oligonucleotide
aatgacacgatcactcccgttgag

SEQ ID NO: 1094 - DNA, 17 bp, Artificial Sequence
  Description of Artificial Sequence: Synthetic oligonucleotide
tgggttgagagggcgaa

SEQ ID NO: 1095 - DNA, 24 bp, Artificial Sequence
  Description of Artificial Sequence: Synthetic oligonucleotide
aatgacacgatcactcccgttgag

SEQ ID NO: 1096 - DNA, 20 bp, Artificial Sequence
  Description of Artificial Sequence: Synthetic oligonucleotide
gaagcgggtgctcttatttt

SEQ ID NO: 1097 - DNA, 19 bp, Artificial Sequence
  Description of Artificial Sequence: Synthetic oligonucleotide
gtgtaagcagggtcgtttt

SEQ ID NO: 1098 - DNA, 18 bp, Artificial Sequence
  Description of Artificial Sequence: Synthetic oligonucleotide
atcccaccgctgctacca

SEQ ID NO: 1099 - DNA, 16 bp, Artificial Sequence
  Description of Artificial Sequence: Synthetic oligonucleotide
gggaaggtgacctgac

SEQ ID NO: 1100 - DNA, 17 bp, Artificial Sequence
  Description of Artificial Sequence: Synthetic oligonucleotide
ctcccgccttttttccc

SEQ ID NO: 1101 - DNA, 14 bp, Artificial Sequence
  Description of Artificial Sequence: Synthetic oligonucleotide
cggagcaagagcgt

SEQ ID NO: 1102 - DNA, 18 bp, Artificial Sequence
  Description of Artificial Sequence: Synthetic oligonucleotide
cccccggcaccatcaata

SEQ ID NO: 1103 - DNA, 17 bp, Artificial Sequence
  Description of Artificial Sequence: Synthetic oligonucleotide
cagcctagcccctaccc

SEQ ID NO: 1104 - DNA, 17 bp, Artificial Sequence
  Description of Artificial Sequence: Synthetic oligonucleotide
cagaaggtctcactttt

SEQ ID NO: 1105 - DNA, 18 bp, Artificial Sequence
  Description of Artificial Sequence: Synthetic oligonucleotide
agtattctctgtggcttt

SEQ ID NO: 1106 - DNA, 24 bp, Artificial Sequence
  Description of Artificial Sequence: Synthetic oligonucleotide
tggagtgactatatggatgccccc

SEQ ID NO: 1107 - DNA, 16 bp, Artificial Sequence
  Description of Artificial Sequence: Synthetic oligonucleotide
tctgatagcttacttt

SEQ ID NO: 1108 - DNA, 20 bp, Artificial Sequence
  Description of Artificial Sequence: Synthetic oligonucleotide
tcgagccccagtggaaccac

SEQ ID NO: 1109 - DNA, 27 bp, Artificial Sequence
  Description of Artificial Sequence: Synthetic oligonucleotide
tcctccccacactcatcgcccttacca

SEQ ID NO: 1110 - DNA, 18 bp, Artificial Sequence
  Description of Artificial Sequence: Synthetic oligonucleotide
tatactacaaggacacca

SEQ ID NO: 1111 - DNA, 21 bp, Artificial Sequence
  Description of Artificial Sequence: Synthetic oligonucleotide
tagtgggtgaaaaaaaaaaaa

SEQ ID NO: 1112 - DNA, 24 bp, Artificial Sequence
  Description of Artificial Sequence: Synthetic oligonucleotide
taccacacattcgaagaacccgta

SEQ ID NO: 1113 - DNA, 26 bp, Artificial Sequence
  Description of Artificial Sequence: Synthetic oligonucleotide
tacaaaacccaccccattcctcccca

SEQ ID NO: 1114 - DNA, 19 bp, Artificial Sequence
  Description of Artificial Sequence: Synthetic oligonucleotide
ggagggggggtaaaaaaaa

SEQ ID NO: 1115 - DNA, 18 bp, Artificial Sequence
  Description of Artificial Sequence: Synthetic oligonucleotide
gccctcctaatgacctcc

SEQ ID NO: 1116 - DNA, 21 bp, Artificial Sequence
  Description of Artificial Sequence: Synthetic oligonucleotide
cttccctctacacttatcatc

SEQ ID NO: 1117 - DNA, 19 bp, Artificial Sequence
  Description of Artificial Sequence: Synthetic oligonucleotide
cgggcggcctgcgctctca

SEQ ID NO: 1118 - DNA, 23 bp, Artificial Sequence
  Description of Artificial Sequence: Synthetic oligonucleotide
cccgaggccgtgtgcaaatgcat

SEQ ID NO: 1119 - DNA, 16 bp, Artificial Sequence
  Description of Artificial Sequence: Synthetic oligonucleotide
ccccggcatctccacc

SEQ ID NO: 1120 - DNA, 18 bp, Artificial Sequence
  Description of Artificial Sequence: Synthetic oligonucleotide
cccccagtacctccacca

SEQ ID NO: 1121 - DNA, 27 bp, Artificial Sequence
  Description of Artificial Sequence: Synthetic oligonucleotide
cccccactgctaaacttgactggcttt

SEQ ID NO: 1122 - DNA, 20 bp, Artificial Sequence
  Description of Artificial Sequence: Synthetic oligonucleotide
cccactccaccttactacca

SEQ ID NO: 1123 - DNA, 19 bp, Artificial Sequence
  Description of Artificial Sequence: Synthetic oligonucleotide
cccaagaacagggtgacca

SEQ ID NO: 1124 - DNA, 18 bp, Artificial Sequence
  Description of Artificial Sequence: Synthetic oligonucleotide
ccagtcgcggccaaatca

SEQ ID NO: 1125 - DNA, 24 bp, Artificial Sequence
  Description of Artificial Sequence: Synthetic oligonucleotide
ccagcttcaccaaggtattggtta

SEQ ID NO: 1126 - DNA, 18 bp, Artificial Sequence
  Description of Artificial Sequence: Synthetic oligonucleotide
ccagaaaaaacaggcctc

SEQ ID NO: 1127 - DNA, 25 bp, Artificial Sequence
  Description of Artificial Sequence: Synthetic oligonucleotide
catcataatcggaggctttggcaac

SEQ ID NO: 1128 - DNA, 26 bp, Artificial Sequence
  Description of Artificial Sequence: Synthetic oligonucleotide
cagcaggggtaataagtgaaatcaaa

SEQ ID NO: 1129 - DNA, 28 bp, Artificial Sequence
  Description of Artificial Sequence: Synthetic oligonucleotide
caatggtgcagccgctattaaaggttca

SEQ ID NO: 1130 - DNA, 21 bp, Artificial Sequence
  Description of Artificial Sequence: Synthetic oligonucleotide
caactcctacatacttccccc

SEQ ID NO: 1131 - DNA, 27 bp, Artificial Sequence
  Description of Artificial Sequence: Synthetic oligonucleotide
atgcatctcatatgcgaataggaatgc

SEQ ID NO: 1132 - DNA, 17 bp, Artificial Sequence
  Description of Artificial Sequence: Synthetic oligonucleotide
atcccacttctgtacca

SEQ ID NO: 1133 - DNA, 28 bp, Artificial Sequence
  Description of Artificial Sequence: Synthetic oligonucleotide
ataacactagaaagttggggcagattgc

SEQ ID NO: 1134 - DNA, 28 bp, Artificial Sequence
  Description of Artificial Sequence: Synthetic oligonucleotide
acgtgggcacattacccgtctgacctga

SEQ ID NO: 1135 - DNA, 16 bp, Artificial Sequence
  Description of Artificial Sequence: Synthetic oligonucleotide
accccttattaaccca

SEQ ID NO: 1136 - DNA, 27 bp, Artificial Sequence
  Description of Artificial Sequence: Synthetic oligonucleotide
acaaggcacacctacaccccttatccc

SEQ ID NO: 1137 - DNA, 19 bp, Artificial Sequence
  Description of Artificial Sequence: Synthetic oligonucleotide
aaaagacacccccccacca

SEQ ID NO: 1138 - DNA, 21 bp, Artificial Sequence
  Description of Artificial Sequence: Synthetic oligonucleotide
aaaacccctacgcatttatat

SEQ ID NO: 1139 - DNA, 19 bp, Artificial Sequence
  Description of Artificial Sequence: Synthetic oligonucleotide
aaaaagacaccccccacca

SEQ ID NO: 1140 - DNA, 21 bp, Artificial Sequence
  Description of Artificial Sequence: Synthetic oligonucleotide
gctaaacctagccccaaaccc

SEQ ID NO: 1141 - DNA, 18 bp, Artificial Sequence
  Description of Artificial Sequence: Synthetic oligonucleotide
accccactcctggtacca

SEQ ID NO: 1142 - DNA, 26 bp, Artificial Sequence
  Description of Artificial Sequence: Synthetic oligonucleotide
tgcccccatgtctaacaacatggcta

SEQ ID NO: 1143 - DNA, 15 bp, Artificial Sequence
  Description of Artificial Sequence: Synthetic oligonucleotide
ccccgcctgtttacc

SEQ ID NO: 1144 - DNA, 16 bp, Artificial Sequence
  Description of Artificial Sequence: Synthetic oligonucleotide
cccacttctgacacca

SEQ ID NO: 1145 - DNA, 19 bp, Artificial Sequence
  Description of Artificial Sequence: Synthetic oligonucleotide
caccacctcttgctcagcc

SEQ ID NO: 1146 - DNA, 24 bp, Artificial Sequence
  Description of Artificial Sequence: Synthetic oligonucleotide
ctggaaagtgcacttggacgaaca

SEQ ID NO: 1147 - DNA, 16 bp, Artificial Sequence
  Description of Artificial Sequence: Synthetic oligonucleotide
tgaccgctctgaccac

SEQ ID NO: 1148 - DNA, 20 bp, Artificial Sequence
  Description of Artificial Sequence: Synthetic oligonucleotide
tgaagtccctttgctttgtt

SEQ ID NO: 1149 - DNA, 23 bp, Artificial Sequence
  Description of Artificial Sequence: Synthetic oligonucleotide
tgaacacacaatagctaagaccc

SEQ ID NO: 1150 - DNA, 18 bp, Artificial Sequence
  Description of Artificial Sequence: Synthetic oligonucleotide
tcgccttaccccccacta

SEQ ID NO: 1151 - DNA, 21 bp, Artificial Sequence
  Description of Artificial Sequence: Synthetic oligonucleotide
tcgataaaccccgatcaacct

SEQ ID NO: 1152 - DNA, 18 bp, Artificial Sequence
  Description of Artificial Sequence: Synthetic oligonucleotide
tccccgtcacctccacca

SEQ ID NO: 1153 - DNA, 17 bp, Artificial Sequence
  Description of Artificial Sequence: Synthetic oligonucleotide
tccccggcactccacca

SEQ ID NO: 1154 - DNA, 17 bp, Artificial Sequence
  Description of Artificial Sequence: Synthetic oligonucleotide
tccccccgctgccacca

SEQ ID NO: 1155 - DNA, 18 bp, Artificial Sequence
  Description of Artificial Sequence: Synthetic oligonucleotide
tcccccccatctccacca

SEQ ID NO: 1156 - DNA, 19 bp, Artificial Sequence
  Description of Artificial Sequence: Synthetic oligonucleotide
tacacaccgcccgtcaccc

SEQ ID NO: 1157 - DNA, 24 bp, Artificial Sequence
  Description of Artificial Sequence: Synthetic oligonucleotide
gcttagcctagccacacccccacg

SEQ ID NO: 1158 - DNA, 19 bp, Artificial Sequence
  Description of Artificial Sequence: Synthetic oligonucleotide
gctcgccagaacactacga

SEQ ID NO: 1159 - DNA, 17 bp, Artificial Sequence
  Description of Artificial Sequence: Synthetic oligonucleotide
gccggggggcgggcgca

SEQ ID NO: 1160 - DNA, 19 bp, Artificial Sequence
  Description of Artificial Sequence: Synthetic oligonucleotide
gaaccgggcgggaacacca

SEQ ID NO: 1161 - DNA, 20 bp, Artificial Sequence
  Description of Artificial Sequence: Synthetic oligonucleotide
cgccgcagtactgatcattc

SEQ ID NO: 1162 - DNA, 20 bp, Artificial Sequence
  Description of Artificial Sequence: Synthetic oligonucleotide
ccgcaccaataggatcctcc

SEQ ID NO: 1163 - DNA, 16 bp, Artificial Sequence
  Description of Artificial Sequence: Synthetic oligonucleotide
cccggccgacgcacca

SEQ ID NO: 1164 - DNA, 20 bp, Artificial Sequence
  Description of Artificial Sequence: Synthetic oligonucleotide
ccaccccatcatactctttc

SEQ ID NO: 1165 - DNA, 20 bp, Artificial Sequence
  Description of Artificial Sequence: Synthetic oligonucleotide
caccccccagctcctccttt

SEQ ID NO: 1166 - DNA, 26 bp, Artificial Sequence
  Description of Artificial Sequence: Synthetic oligonucleotide
ataagtaacatgaaaacattctcctc

SEQ ID NO: 1167 - DNA, 17 bp, Artificial Sequence
  Description of Artificial Sequence: Synthetic oligonucleotide
actgctcgccagaacac

SEQ ID NO: 1168 - DNA, 25 bp, Artificial Sequence
  Description of Artificial Sequence: Synthetic oligonucleotide
accctggtgtgggatctgcccgatc

SEQ ID NO: 1169 - DNA, 19 bp, Artificial Sequence
  Description of Artificial Sequence: Synthetic oligonucleotide
aacctcaccacctctttct

SEQ ID NO: 1170 - DNA, 20 bp, Artificial Sequence
  Description of Artificial Sequence: Synthetic oligonucleotide
aaaagacaccccccacacca

SEQ ID NO: 1171 - DNA, 17 bp, Artificial Sequence
  Description of Artificial Sequence: Synthetic oligonucleotide
accgggcggaaacacca

SEQ ID NO: 1172 - DNA, 30 bp, Artificial Sequence; identical to SEQ ID NO: 407
  Description of Artificial Sequence: Synthetic oligonucleotide

SEQ ID NO: 1173 - DNA, 15 bp, Artificial Sequence
  Description of Artificial Sequence: Synthetic oligonucleotide
ggccgtgatcgtata

SEQ ID NO: 1174 - DNA, 17 bp, Artificial Sequence
  Description of Artificial Sequence: Synthetic oligonucleotide
ccccgtactggccacca

SEQ ID NO: 1175 - DNA, 22 bp, Artificial Sequence
  Description of Artificial Sequence: Synthetic oligonucleotide
tgggatgcgagaggtcccgggt

SEQ ID NO: 1176 - DNA, 22 bp, Artificial Sequence
  Description of Artificial Sequence: Synthetic oligonucleotide
tcgaatcctgttcgtgacgcca

SEQ ID NO: 1177 - DNA, 17 bp, Artificial Sequence
  Description of Artificial Sequence: Synthetic oligonucleotide
ctgaactcctcacaccc

SEQ ID NO: 1178 - DNA, 18 bp, Artificial Sequence
  Description of Artificial Sequence: Synthetic oligonucleotide
attcaaaaaagagtacca

SEQ ID NO: 1179 - DNA, 22 bp, Artificial Sequence
  Description of Artificial Sequence: Synthetic oligonucleotide
attaatcccctggcccaacccg

SEQ ID NO: 1180 - DNA, 19 bp, Artificial Sequence
  Description of Artificial Sequence: Synthetic oligonucleotide
agccccaaacccactccac

SEQ ID NO: 1181 - DNA, 18 bp, Artificial Sequence
  Description of Artificial Sequence: Synthetic oligonucleotide
cgcgacctcagatcagac

SEQ ID NO: 1182 - DNA, 17 bp, Artificial Sequence
  Description of Artificial Sequence: Synthetic oligonucleotide
ggccggtgatgagaact

SEQ ID NO: 1183 - DNA, 27 bp, Artificial Sequence
  Description of Artificial Sequence: Synthetic oligonucleotide
tcaagtgatgtcatcttactactgaga

SEQ ID NO: 1184 - DNA, 22 bp, Artificial Sequence
  Description of Artificial Sequence: Synthetic oligonucleotide
ttgggtgcgagaggtcccgggt

SEQ ID NO: 1185 - DNA, 17 bp, Artificial Sequence
  Description of Artificial Sequence: Synthetic oligonucleotide
tctcggtgggacctcca

SEQ ID NO: 1186 - DNA, 17 bp, Artificial Sequence
  Description of Artificial Sequence: Synthetic oligonucleotide
ccgccccccgttccccc

SEQ ID NO: 1187 - DNA, 24 bp, Artificial Sequence
  Description of Artificial Sequence: Synthetic oligonucleotide
cccactgctaaatttgactggctt

SEQ ID NO: 1188 - DNA, 17 bp, Artificial Sequence
  Description of Artificial Sequence: Synthetic oligonucleotide
acagaccaagagccttc

SEQ ID NO: 1189 - DNA, 25 bp, Artificial Sequence
  Description of Artificial Sequence: Synthetic oligonucleotide
tgtagtagtcaattaatggatatta

SEQ ID NO: 1190 - DNA, 27 bp, Artificial Sequence
  Description of Artificial Sequence: Synthetic oligonucleotide
tggttatcacgttcgcctcacacgcga

SEQ ID NO: 1191 - DNA, 15 bp, Artificial Sequence
  Description of Artificial Sequence: Synthetic oligonucleotide
tgggaataccgggtg

SEQ ID NO: 1192 - DNA, 27 bp, Artificial Sequence
  Description of Artificial Sequence: Synthetic oligonucleotide
tggcggccaagcgttcatagcgacgtc

SEQ ID NO: 1193 - DNA, 24 bp, Artificial Sequence
  Description of Artificial Sequence: Synthetic oligonucleotide
tcgtcatccagctaagggctcaga

SEQ ID NO: 1194 - DNA, 26 bp, Artificial Sequence
  Description of Artificial Sequence: Synthetic oligonucleotide
tcgcctgccacgcgggaggcccgggt

SEQ ID NO: 1195 - DNA, 18 bp, Artificial Sequence
  Description of Artificial Sequence: Synthetic oligonucleotide
tcccactgcttcacttga

SEQ ID NO: 1196 - DNA, 25 bp, Artificial Sequence
  Description of Artificial Sequence: Synthetic oligonucleotide
gtttagacgggctcacatcacccca

SEQ ID NO: 1197 - DNA, 23 bp, Artificial Sequence
  Description of Artificial Sequence: Synthetic oligonucleotide
ggccggtgatgagaacttctccc

SEQ ID NO: 1198 - DNA, 21 bp, Artificial Sequence
  Description of Artificial Sequence: Synthetic oligonucleotide
gctaactcatgcccccatgtc

SEQ ID NO: 1199 - DNA, 20 bp, Artificial Sequence
  Description of Artificial Sequence: Synthetic oligonucleotide
gactgtggtggttgaatata

SEQ ID NO: 1200 - DNA, 27 bp, Artificial Sequence
  Description of Artificial Sequence: Synthetic oligonucleotide
cgcgacctcagatcagacgtggcgacc

SEQ ID NO: 1201 - DNA, 15 bp, Artificial Sequence
  Description of Artificial Sequence: Synthetic oligonucleotide
cgccgccgccccccc

SEQ ID NO: 1202 - DNA, 22 bp, Artificial Sequence
  Description of Artificial Sequence: Synthetic oligonucleotide
cgcccgactaccaccacatcca

SEQ ID NO: 1203 - DNA, 17 bp, Artificial Sequence
  Description of Artificial Sequence: Synthetic oligonucleotide
cccccctccacgcgccc

SEQ ID NO: 1204 - DNA, 17 bp, Artificial Sequence
  Description of Artificial Sequence: Synthetic oligonucleotide
ccccaccccgcgccctc

SEQ ID NO: 1205 - DNA, 29 bp, Artificial Sequence
  Description of Artificial Sequence: Synthetic oligonucleotide
cagagtgtagcttaacacaaagcacccaa

SEQ ID NO: 1206 - DNA, 29 bp, Artificial Sequence
  Description of Artificial Sequence: Synthetic oligonucleotide
caatcttggcatgttggtctggtcaccca

SEQ ID NO: 1207 - DNA, 19 bp, Artificial Sequence
  Description of Artificial Sequence: Synthetic oligonucleotide
caaagcatcgcgaaggccc

SEQ ID NO: 1208 - DNA, 25 bp, Artificial Sequence
  Description of Artificial Sequence: Synthetic oligonucleotide
aacaccctgattgctcctgtctgat

SEQ ID NO: 1209 - DNA, 23 bp, Artificial Sequence
  Description of Artificial Sequence: Synthetic oligonucleotide
aaaaagggcctaaagaagatgca

SEQ ID NO: 1210 - DNA, 20 bp, Artificial Sequence
  Description of Artificial Sequence: Synthetic oligonucleotide
gaagcgggtgctcttatttt

SEQ ID NO: 1211 - DNA, 19 bp, Artificial Sequence
  Description of Artificial Sequence: Synthetic oligonucleotide
gtgtaagcagggtcgtttt

SEQ ID NO: 1212 - DNA, 18 bp, Artificial Sequence
  Description of Artificial Sequence: Synthetic oligonucleotide
atcccaccgctgctacca

SEQ ID NO: 1213 - DNA, 16 bp, Artificial Sequence
  Description of Artificial Sequence: Synthetic oligonucleotide
gggaaggtgacctgac

SEQ ID NO: 1214 - DNA, 17 bp, Artificial Sequence
  Description of Artificial Sequence: Synthetic oligonucleotide
ctcccgccttttttccc

SEQ ID NO: 1215 - DNA, 14 bp, Artificial Sequence
  Description of Artificial Sequence: Synthetic oligonucleotide
cggagcaagagcgt

SEQ ID NO: 1216 - DNA, 18 bp, Artificial Sequence
  Description of Artificial Sequence: Synthetic oligonucleotide
cccccggcaccatcaata

SEQ ID NO: 1217 - DNA, 17 bp, Artificial Sequence
  Description of Artificial Sequence: Synthetic oligonucleotide
cagcctagcccctaccc

SEQ ID NO: 1218 - DNA, 17 bp, Artificial Sequence
  Description of Artificial Sequence: Synthetic oligonucleotide
cagaaggtctcactttt

SEQ ID NO: 1219 - DNA, 18 bp, Artificial Sequence
  Description of Artificial Sequence: Synthetic oligonucleotide
agtattctctgtggcttt

SEQ ID NO: 1220 - DNA, 24 bp, Artificial Sequence
  Description of Artificial Sequence: Synthetic oligonucleotide
tggagtgactatatggatgccccc

SEQ ID NO: 1221 - DNA, 16 bp, Artificial Sequence
  Description of Artificial Sequence: Synthetic oligonucleotide
tctgatagcttacttt

SEQ ID NO: 1222 - DNA, 20 bp, Artificial Sequence
  Description of Artificial Sequence: Synthetic oligonucleotide
tcgagccccagtggaaccac

SEQ ID NO: 1223 - DNA, 27 bp, Artificial Sequence
  Description of Artificial Sequence: Synthetic oligonucleotide
tcctccccacactcatcgcccttacca

SEQ ID NO: 1224 - DNA, 18 bp, Artificial Sequence
  Description of Artificial Sequence: Synthetic oligonucleotide
tatactacaaggacacca

SEQ ID NO: 1225 - DNA, 21 bp, Artificial Sequence
  Description of Artificial Sequence: Synthetic oligonucleotide
tagtgggtgaaaaaaaaaaaa

SEQ ID NO: 1226 - DNA, 24 bp, Artificial Sequence
  Description of Artificial Sequence: Synthetic oligonucleotide
taccacacattcgaagaacccgta

SEQ ID NO: 1227 - DNA, 26 bp, Artificial Sequence
  Description of Artificial Sequence: Synthetic oligonucleotide
tacaaaacccaccccattcctcccca

SEQ ID NO: 1228 - DNA, 19 bp, Artificial Sequence
  Description of Artificial Sequence: Synthetic oligonucleotide
ggagggggggtaaaaaaaa

SEQ ID NO: 1229 - DNA, 18 bp, Artificial Sequence
  Description of Artificial Sequence: Synthetic oligonucleotide
gccctcctaatgacctcc

SEQ ID NO: 1230 - DNA, 21 bp, Artificial Sequence
  Description of Artificial Sequence: Synthetic oligonucleotide
cttccctctacacttatcatc

SEQ ID NO: 1231 - DNA, 19 bp, Artificial Sequence
  Description of Artificial Sequence: Synthetic oligonucleotide
cgggcggcctgcgctctca

SEQ ID NO: 1232 - DNA, 23 bp, Artificial Sequence
  Description of Artificial Sequence: Synthetic oligonucleotide
cccgaggccgtgtgcaaatgcat

SEQ ID NO: 1233 - DNA, 16 bp, Artificial Sequence
  Description of Artificial Sequence: Synthetic oligonucleotide
ccccggcatctccacc

SEQ ID NO: 1234 - DNA, 18 bp, Artificial Sequence
  Description of Artificial Sequence: Synthetic oligonucleotide
cccccagtacctccacca

SEQ ID NO: 1235 - DNA, 27 bp, Artificial Sequence
  Description of Artificial Sequence: Synthetic oligonucleotide
cccccactgctaaacttgactggcttt

SEQ ID NO: 1236 - DNA, 20 bp, Artificial Sequence
  Description of Artificial Sequence: Synthetic oligonucleotide
cccactccaccttactacca

SEQ ID NO: 1237 - DNA, 19 bp, Artificial Sequence
  Description of Artificial Sequence: Synthetic oligonucleotide
cccaagaacagggtgacca

SEQ ID NO: 1238 - DNA, 18 bp, Artificial Sequence
  Description of Artificial Sequence: Synthetic oligonucleotide
ccagtcgcggccaaatca

SEQ ID NO: 1239 - DNA, 24 bp, Artificial Sequence
  Description of Artificial Sequence: Synthetic oligonucleotide
ccagcttcaccaaggtattggtta

SEQ ID NO: 1240 - DNA, 18 bp, Artificial Sequence
  Description of Artificial Sequence: Synthetic oligonucleotide
ccagaaaaaacaggcctc

SEQ ID NO: 1241 - DNA, 25 bp, Artificial Sequence
  Description of Artificial Sequence: Synthetic oligonucleotide
catcataatcggaggctttggcaac

SEQ ID NO: 1242 - DNA, 26 bp, Artificial Sequence
  Description of Artificial Sequence: Synthetic oligonucleotide
cagcaggggtaataagtgaaatcaaa

SEQ ID NO: 1243 - DNA, 28 bp, Artificial Sequence
  Description of Artificial Sequence: Synthetic oligonucleotide
caatggtgcagccgctattaaaggttca

SEQ ID NO: 1244 - DNA, 21 bp, Artificial Sequence
  Description of Artificial Sequence: Synthetic oligonucleotide
caactcctacatacttccccc

SEQ ID NO: 1245 - DNA, 27 bp, Artificial Sequence
  Description of Artificial Sequence: Synthetic oligonucleotide
atgcatctcatatgcgaataggaatgc

SEQ ID NO: 1246 - DNA, 17 bp, Artificial Sequence
  Description of Artificial Sequence: Synthetic oligonucleotide
atcccacttctgtacca

SEQ ID NO: 1247 - DNA, 28 bp, Artificial Sequence
  Description of Artificial Sequence: Synthetic oligonucleotide
ataacactagaaagttggggcagattgc

SEQ ID NO: 1248 - DNA, 28 bp, Artificial Sequence
  Description of Artificial Sequence: Synthetic oligonucleotide
acgtgggcacattacccgtctgacctga

SEQ ID NO: 1249 - DNA, 16 bp, Artificial Sequence
  Description of Artificial Sequence: Synthetic oligonucleotide
accccttattaaccca

SEQ ID NO: 1250 - DNA, 27 bp, Artificial Sequence
  Description of Artificial Sequence: Synthetic oligonucleotide
acaaggcacacctacaccccttatccc

SEQ ID NO: 1251 - DNA, 19 bp, Artificial Sequence
  Description of Artificial Sequence: Synthetic oligonucleotide
aaaagacacccccccacca

SEQ ID NO: 1252 - DNA, 21 bp, Artificial Sequence
  Description of Artificial Sequence: Synthetic oligonucleotide
aaaacccctacgcatttatat

SEQ ID NO: 1253 - DNA, 19 bp, Artificial Sequence
  Description of Artificial Sequence: Synthetic oligonucleotide
aaaaagacaccccccacca

SEQ ID NO: 1254 - DNA, 21 bp, Artificial Sequence
  Description of Artificial Sequence: Synthetic oligonucleotide
gctaaacctagccccaaaccc

SEQ ID NO: 1255 - DNA, 18 bp, Artificial Sequence
  Description of Artificial Sequence: Synthetic oligonucleotide
accccactcctggtacca

SEQ ID NO: 1256 - DNA, 26 bp, Artificial Sequence
  Description of Artificial Sequence: Synthetic oligonucleotide
tgcccccatgtctaacaacatggcta

SEQ ID NO: 1257 - DNA, 15 bp, Artificial Sequence
  Description of Artificial Sequence: Synthetic oligonucleotide
ccccgcctgtttacc

SEQ ID NO: 1258 - DNA, 16 bp, Artificial Sequence
  Description of Artificial Sequence: Synthetic oligonucleotide
cccacttctgacacca

SEQ ID NO: 1259 - DNA, 19 bp, Artificial Sequence
  Description of Artificial Sequence: Synthetic oligonucleotide
caccacctcttgctcagcc

SEQ ID NO: 1260 - DNA, 24 bp, Artificial Sequence
  Description of Artificial Sequence: Synthetic oligonucleotide
ctggaaagtgcacttggacgaaca

SEQ ID NO: 1261 - DNA, 16 bp, Artificial Sequence
  Description of Artificial Sequence: Synthetic oligonucleotide
tgaccgctctgaccac

SEQ ID NO: 1262 - DNA, 20 bp, Artificial Sequence
  Description of Artificial Sequence: Synthetic oligonucleotide
tgaagtccctttgctttgtt

SEQ ID NO: 1263 - DNA, 23 bp, Artificial Sequence
  Description of Artificial Sequence: Synthetic oligonucleotide
tgaacacacaatagctaagaccc

SEQ ID NO: 1264 - DNA, 18 bp, Artificial Sequence
  Description of Artificial Sequence: Synthetic oligonucleotide
tcgccttaccccccacta

SEQ ID NO: 1265 - DNA, 21 bp, Artificial Sequence
  Description of Artificial Sequence: Synthetic oligonucleotide
tcgataaaccccgatcaacct

SEQ ID NO: 1266 - DNA, 18 bp, Artificial Sequence
  Description of Artificial Sequence: Synthetic oligonucleotide
tccccgtcacctccacca

SEQ ID NO: 1267 - DNA, 17 bp, Artificial Sequence
  Description of Artificial Sequence: Synthetic oligonucleotide
tccccggcactccacca

SEQ ID NO: 1268 - DNA, 17 bp, Artificial Sequence
  Description of Artificial Sequence: Synthetic oligonucleotide
tccccccgctgccacca

SEQ ID NO: 1269 - DNA, 18 bp, Artificial Sequence
  Description of Artificial Sequence: Synthetic oligonucleotide
tcccccccatctccacca

SEQ ID NO: 1270 - DNA, 19 bp, Artificial Sequence
  Description of Artificial Sequence: Synthetic oligonucleotide
tacacaccgcccgtcaccc

SEQ ID NO: 1271 - DNA, 24 bp, Artificial Sequence
  Description of Artificial Sequence: Synthetic oligonucleotide
gcttagcctagccacacccccacg

SEQ ID NO: 1272 - DNA, 19 bp, Artificial Sequence
  Description of Artificial Sequence: Synthetic oligonucleotide
gctcgccagaacactacga

SEQ ID NO: 1273 - DNA, 17 bp, Artificial Sequence
  Description of Artificial Sequence: Synthetic oligonucleotide
gccggggggcgggcgca

SEQ ID NO: 1274 - DNA, 19 bp, Artificial Sequence
  Description of Artificial Sequence: Synthetic oligonucleotide
gaaccgggcgggaacacca

SEQ ID NO: 1275 - DNA, 20 bp, Artificial Sequence
  Description of Artificial Sequence: Synthetic oligonucleotide
cgccgcagtactgatcattc

SEQ ID NO: 1276 - DNA, 20 bp, Artificial Sequence
  Description of Artificial Sequence: Synthetic oligonucleotide
ccgcaccaataggatcctcc

SEQ ID NO: 1277 - DNA, 16 bp, Artificial Sequence
  Description of Artificial Sequence: Synthetic oligonucleotide
cccggccgacgcacca

SEQ ID NO: 1278 - DNA, 20 bp, Artificial Sequence
  Description of Artificial Sequence: Synthetic oligonucleotide
ccaccccatcatactctttc

SEQ ID NO: 1279 - DNA, 20 bp, Artificial Sequence
  Description of Artificial Sequence: Synthetic oligonucleotide
caccccccagctcctccttt

SEQ ID NO: 1280 - DNA, 26 bp, Artificial Sequence
  Description of Artificial Sequence: Synthetic oligonucleotide
ataagtaacatgaaaacattctcctc

SEQ ID NO: 1281 - DNA, 17 bp, Artificial Sequence
  Description of Artificial Sequence: Synthetic oligonucleotide
actgctcgccagaacac

SEQ ID NO: 1282 - DNA, 25 bp, Artificial Sequence
  Description of Artificial Sequence: Synthetic oligonucleotide
accctggtgtgggatctgcccgatc

SEQ ID NO: 1283 - DNA, 19 bp, Artificial Sequence
  Description of Artificial Sequence: Synthetic oligonucleotide
aacctcaccacctctttct

SEQ ID NO: 1284 - DNA, 20 bp, Artificial Sequence
  Description of Artificial Sequence: Synthetic oligonucleotide
aaaagacaccccccacacca

SEQ ID NO: 1285 - DNA, 17 bp, Artificial Sequence
  Description of Artificial Sequence: Synthetic oligonucleotide
accgggcggaaacacca

SEQ ID NO: 1286 - DNA, 30 bp, Artificial Sequence; identical to SEQ ID NO: 407
  Description of Artificial Sequence: Synthetic oligonucleotide

SEQ ID NO: 1287 - DNA, 15 bp, Artificial Sequence
  Description of Artificial Sequence: Synthetic oligonucleotide
ggccgtgatcgtata

SEQ ID NO: 1288 - DNA, 17 bp, Artificial Sequence
  Description of Artificial Sequence: Synthetic oligonucleotide
ccccgtactggccacca

SEQ ID NO: 1289 - DNA, 22 bp, Artificial Sequence
  Description of Artificial Sequence: Synthetic oligonucleotide
tgggatgcgagaggtcccgggt

SEQ ID NO: 1290 - DNA, 22 bp, Artificial Sequence
  Description of Artificial Sequence: Synthetic oligonucleotide
tcgaatcctgttcgtgacgcca

SEQ ID NO: 1291 - DNA, 17 bp, Artificial Sequence
  Description of Artificial Sequence: Synthetic oligonucleotide
ctgaactcctcacaccc

SEQ ID NO: 1292 - DNA, 18 bp, Artificial Sequence
  Description of Artificial Sequence: Synthetic oligonucleotide
attcaaaaaagagtacca

SEQ ID NO: 1293 - DNA, 22 bp, Artificial Sequence
  Description of Artificial Sequence: Synthetic oligonucleotide
attaatcccctggcccaacccg

SEQ ID NO: 1294 - DNA, 19 bp, Artificial Sequence
  Description of Artificial Sequence: Synthetic oligonucleotide
agccccaaacccactccac

SEQ ID NO: 1295 - DNA, 18 bp, Artificial Sequence
  Description of Artificial Sequence: Synthetic oligonucleotide
cgcgacctcagatcagac

SEQ ID NO: 1296 - DNA, 17 bp, Artificial Sequence
  Description of Artificial Sequence: Synthetic oligonucleotide
ggccggtgatgagaact

SEQ ID NO: 1297 - DNA, 27 bp, Artificial Sequence
  Description of Artificial Sequence: Synthetic oligonucleotide
tcaagtgatgtcatcttactactgaga

SEQ ID NO: 1298 - DNA, 22 bp, Artificial Sequence
  Description of Artificial Sequence: Synthetic oligonucleotide
ttgggtgcgagaggtcccgggt

SEQ ID NO: 1299 - DNA, 17 bp, Artificial Sequence
  Description of Artificial Sequence: Synthetic oligonucleotide
tctcggtgggacctcca

SEQ ID NO: 1300 - DNA, 17 bp, Artificial Sequence
  Description of Artificial Sequence: Synthetic oligonucleotide
ccgccccccgttccccc

SEQ ID NO: 1301 - DNA, 24 bp, Artificial Sequence
  Description of Artificial Sequence: Synthetic oligonucleotide
cccactgctaaatttgactggctt

SEQ ID NO: 1302 - DNA, 17 bp, Artificial Sequence
  Description of Artificial Sequence: Synthetic oligonucleotide
acagaccaagagccttc

SEQ ID NO: 1303 - DNA, 25 bp, Artificial Sequence
  Description of Artificial Sequence: Synthetic oligonucleotide
tgtagtagtcaattaatggatatta

SEQ ID NO: 1304 - DNA, 27 bp, Artificial Sequence
  Description of Artificial Sequence: Synthetic oligonucleotide
tggttatcacgttcgcctcacacgcga

SEQ ID NO: 1305 - DNA, 15 bp, Artificial Sequence
  Description of Artificial Sequence: Synthetic oligonucleotide
tgggaataccgggtg

SEQ ID NO: 1306 - DNA, 27 bp, Artificial Sequence
  Description of Artificial Sequence: Synthetic oligonucleotide
tggcggccaagcgttcatagcgacgtc

SEQ ID NO: 1307 - DNA, 24 bp, Artificial Sequence
  Description of Artificial Sequence: Synthetic oligonucleotide
tcgtcatccagctaagggctcaga

SEQ ID NO: 1308 - DNA, 26 bp, Artificial Sequence
  Description of Artificial Sequence: Synthetic oligonucleotide
tcgcctgccacgcgggaggcccgggt

SEQ ID NO: 1309 - DNA, 18 bp, Artificial Sequence
  Description of Artificial Sequence: Synthetic oligonucleotide
tcccactgcttcacttga

SEQ ID NO: 1310 - DNA, 25 bp, Artificial Sequence
  Description of Artificial Sequence: Synthetic oligonucleotide
gtttagacgggctcacatcacccca

SEQ ID NO: 1311 - DNA, 23 bp, Artificial Sequence
  Description of Artificial Sequence: Synthetic oligonucleotide
ggccggtgatgagaacttctccc

SEQ ID NO: 1312 - DNA, 21 bp, Artificial Sequence
  Description of Artificial Sequence: Synthetic oligonucleotide
gctaactcatgcccccatgtc

SEQ ID NO: 1313 - DNA, 20 bp, Artificial Sequence
  Description of Artificial Sequence: Synthetic oligonucleotide
gactgtggtggttgaatata

SEQ ID NO: 1314 - DNA, 27 bp, Artificial Sequence
  Description of Artificial Sequence: Synthetic oligonucleotide
cgcgacctcagatcagacgtggcgacc

SEQ ID NO: 1315 - DNA, 15 bp, Artificial Sequence
  Description of Artificial Sequence: Synthetic oligonucleotide
cgccgccgccccccc

SEQ ID NO: 1316 - DNA, 22 bp, Artificial Sequence
  Description of Artificial Sequence: Synthetic oligonucleotide
cgcccgactaccaccacatcca

SEQ ID NO: 1317 - DNA, 17 bp, Artificial Sequence
  Description of Artificial Sequence: Synthetic oligonucleotide
cccccctccacgcgccc

SEQ ID NO: 1318 - DNA, 17 bp, Artificial Sequence
  Description of Artificial Sequence: Synthetic oligonucleotide
ccccaccccgcgccctc

SEQ ID NO: 1319 - DNA, 29 bp, Artificial Sequence
  Description of Artificial Sequence: Synthetic oligonucleotide
cagagtgtagcttaacacaaagcacccaa

SEQ ID NO: 1320 - DNA, 29 bp, Artificial Sequence
  Description of Artificial Sequence: Synthetic oligonucleotide
caatcttggcatgttggtctggtcaccca

SEQ ID NO: 1321 - DNA, 19 bp, Artificial Sequence
  Description of Artificial Sequence: Synthetic oligonucleotide
caaagcatcgcgaaggccc

SEQ ID NO: 1322 - DNA, 25 bp, Artificial Sequence
  Description of Artificial Sequence: Synthetic oligonucleotide
aacaccctgattgctcctgtctgat

SEQ ID NO: 1323 - DNA, 23 bp, Artificial Sequence
  Description of Artificial Sequence: Synthetic oligonucleotide
aaaaagggcctaaagaagatgca

SEQ ID NO: 1324 - DNA, 23 bp, Artificial Sequence
  Description of Artificial Sequence: Synthetic oligonucleotide
tggctcagttcagcaggaacagt

SEQ ID NO: 1325 - DNA, 19 bp, Artificial Sequence
  Description of Artificial Sequence: Synthetic oligonucleotide
gtgggggagaggctgtcga

SEQ ID NO: 1326 - DNA, 22 bp, Artificial Sequence
  Description of Artificial Sequence: Synthetic oligonucleotide
cggggcagctcagtacaggatt

SEQ ID NO: 1327 - DNA, 23 bp, Artificial Sequence
  Description of Artificial Sequence: Synthetic oligonucleotide
aattgcacggtatccatctgtat

SEQ ID NO: 1328 - DNA, 23 bp, Artificial Sequence
  Description of Artificial Sequence: Synthetic oligonucleotide
tgtcagtttgttaattgacccaa

SEQ ID NO: 1329 - DNA, 18 bp, Artificial Sequence
  Description of Artificial Sequence: Synthetic oligonucleotide
ggcaatacgagcaccctg

SEQ ID NO: 1330 - DNA, 17 bp, Artificial Sequence
  Description of Artificial Sequence: Synthetic oligonucleotide
cgggggagcgccgcgta

SEQ ID NO: 1331 - DNA, 16 bp, Artificial Sequence
  Description of Artificial Sequence: Synthetic oligonucleotide
ccggggcgtctcgtac

SEQ ID NO: 1332 - DNA, 16 bp, Artificial Sequence
  Description of Artificial Sequence: Synthetic oligonucleotide
agcggctgtgcacaaa

SEQ ID NO: 1333 - DNA, 20 bp, Artificial Sequence
  Description of Artificial Sequence: Synthetic oligonucleotide
tgtcagtttgtttaatccaa

SEQ ID NO: 1334 - DNA, 20 bp, Artificial Sequence
  Description of Artificial Sequence: Synthetic oligonucleotide
tgtcagtttgttattaccaa

SEQ ID NO: 1335 - DNA, 19 bp, Artificial Sequence
  Description of Artificial Sequence: Synthetic oligonucleotide
tgtcaggcaccatcaataa

SEQ ID NO: 1336 - DNA, 20 bp, Artificial Sequence
  Description of Artificial Sequence: Synthetic oligonucleotide
tgatcttgacacttaaagcc

SEQ ID NO: 1337 - DNA, 17 bp, Artificial Sequence
  Description of Artificial Sequence: Synthetic oligonucleotide
tcgtaggcaccatcaat

SEQ ID NO: 1338 - DNA, 22 bp, Artificial Sequence
  Description of Artificial Sequence: Synthetic oligonucleotide
tcgatcccgggtttcggcacca

SEQ ID NO: 1339 - DNA, 22 bp, Artificial Sequence
  Description of Artificial Sequence: Synthetic oligonucleotide
tcgactcccggtatgggaacca

SEQ ID NO: 1340 - DNA, 23 bp, Artificial Sequence
  Description of Artificial Sequence: Synthetic oligonucleotide
tagggaggttatgattaactttt

SEQ ID NO: 1341 - DNA, 20 bp, Artificial Sequence
  Description of Artificial Sequence: Synthetic oligonucleotide
taaagtgcttagtgcaggta

SEQ ID NO: 1342 - DNA, 19 bp, Artificial Sequence
  Description of Artificial Sequence: Synthetic oligonucleotide
gtttatgttgcttacctcc

SEQ ID NO: 1343 - DNA, 18 bp, Artificial Sequence
  Description of Artificial Sequence: Synthetic oligonucleotide
gtagataaaatattggcg

SEQ ID NO: 1344 - DNA, 17 bp, Artificial Sequence
  Description of Artificial Sequence: Synthetic oligonucleotide
ggcggggacgacgtcag

SEQ ID NO: 1345 - DNA, 19 bp, Artificial Sequence
  Description of Artificial Sequence: Synthetic oligonucleotide
ggcggcgtcgcggcgggtc

SEQ ID NO: 1346 - DNA, 24 bp, Artificial Sequence
  Description of Artificial Sequence: Synthetic oligonucleotide
ggagggggtgaacaaaaagaaaaa

SEQ ID NO: 1347 - DNA, 29 bp, Artificial Sequence
  Description of Artificial Sequence: Synthetic oligonucleotide
gctaaacctagccccaaacccactccaca

SEQ ID NO: 1348 - DNA, 19 bp, Artificial Sequence
  Description of Artificial Sequence: Synthetic oligonucleotide
ctggatagcgcacttcgtt

SEQ ID NO: 1349 - DNA, 21 bp, Artificial Sequence
  Description of Artificial Sequence: Synthetic oligonucleotide
cgggcgaggggcggacgttcg

SEQ ID NO: 1350 - DNA, 15 bp, Artificial Sequence
  Description of Artificial Sequence: Synthetic oligonucleotide
cggacctataccgga

SEQ ID NO: 1351 - DNA, 30 bp, Artificial Sequence; identical to SEQ ID NO: 679
  Description of Artificial Sequence: Synthetic oligonucleotide

SEQ ID NO: 1352 - DNA, 17 bp, Artificial Sequence
  Description of Artificial Sequence: Synthetic oligonucleotide
ccccccacaaccgcgaa

SEQ ID NO: 1353 - DNA, 20 bp, Artificial Sequence
  Description of Artificial Sequence: Synthetic oligonucleotide
cccagcatctcctgtgttta

SEQ ID NO: 1354 - DNA, 17 bp, Artificial Sequence
  Description of Artificial Sequence: Synthetic oligonucleotide
cccacgttgggacgcca

SEQ ID NO: 1355 - DNA, 23 bp, Artificial Sequence
  Description of Artificial Sequence: Synthetic oligonucleotide
atcgtatcccacttctgacacca

SEQ ID NO: 1356 - DNA, 18 bp, Artificial Sequence
  Description of Artificial Sequence: Synthetic oligonucleotide
atcacgtccgtgcctcca

SEQ ID NO: 1357 - DNA, 21 bp, Artificial Sequence
  Description of Artificial Sequence: Synthetic oligonucleotide
atagcaatgtcagcagtacct

SEQ ID NO: 1358 - DNA, 18 bp, Artificial Sequence
  Description of Artificial Sequence: Synthetic oligonucleotide
accctgctcgctgcgcca

SEQ ID NO: 1359 - DNA, 18 bp, Artificial Sequence
  Description of Artificial Sequence: Synthetic oligonucleotide
tcccacccagggacgcca

SEQ ID NO: 1360 - DNA, 17 bp, Artificial Sequence
  Description of Artificial Sequence: Synthetic oligonucleotide
tcgtaggcacatcaata

SEQ ID NO: 1361 - DNA, 16 bp, Artificial Sequence
  Description of Artificial Sequence: Synthetic oligonucleotide
cccccacaaccgcgta

SEQ ID NO: 1362 - DNA, 18 bp, Artificial Sequence
  Description of Artificial Sequence: Synthetic oligonucleotide
accccgtccgtgcctcca

SEQ ID NO: 1363 - DNA, 19 bp, Artificial Sequence
  Description of Artificial Sequence: Synthetic oligonucleotide
aaaaaagacaccccccaca

SEQ ID NO: 1364 - DNA, 19 bp, Artificial Sequence
  Description of Artificial Sequence: Synthetic oligonucleotide
tgtcagtttgttaacccaa

SEQ ID NO: 1365 - DNA, 22 bp, Artificial Sequence
  Description of Artificial Sequence: Synthetic oligonucleotide
tccctgtggtctagtggttagg

SEQ ID NO: 1366 - DNA, 15 bp, Artificial Sequence
  Description of Artificial Sequence: Synthetic oligonucleotide
gggggggtaaaaaaa

SEQ ID NO: 1367 - DNA, 16 bp, Artificial Sequence
  Description of Artificial Sequence: Synthetic oligonucleotide
ggggggggaaaaaaaa

SEQ ID NO: 1368 - DNA, 17 bp, Artificial Sequence
  Description of Artificial Sequence: Synthetic oligonucleotide
cgggcccgggtcttccc

SEQ ID NO: 1369 - DNA, 19 bp, Artificial Sequence
  Description of Artificial Sequence: Synthetic oligonucleotide
ccgccccccgttcccccca

SEQ ID NO: 1370 - DNA, 19 bp, Artificial Sequence
  Description of Artificial Sequence: Synthetic oligonucleotide
acccccggctcctccacca

SEQ ID NO: 1371 - DNA, 19 bp, Artificial Sequence
  Description of Artificial Sequence: Synthetic oligonucleotide
tttggtggaaattttttga

SEQ ID NO: 1372 - DNA, 19 bp, Artificial Sequence
  Description of Artificial Sequence: Synthetic oligonucleotide
tgtcagtttgttataccaa

SEQ ID NO: 1373 - DNA, 22 bp, Artificial Sequence
  Description of Artificial Sequence: Synthetic oligonucleotide
tgtcagtttgtaattatcccaa

SEQ ID NO: 1374 - DNA, 18 bp, Artificial Sequence
  Description of Artificial Sequence: Synthetic oligonucleotide
tgtcaatttttaacccaa

SEQ ID NO: 1375 - DNA, 19 bp, Artificial Sequence
  Description of Artificial Sequence: Synthetic oligonucleotide
tgctagggtaaaaaaaaaa

SEQ ID NO: 1376 - DNA, 23 bp, Artificial Sequence
  Description of Artificial Sequence: Synthetic oligonucleotide
tgcaactccaaataaaagtacca

SEQ ID NO: 1377 - DNA, 18 bp, Artificial Sequence
  Description of Artificial Sequence: Synthetic oligonucleotide
tgaggtaacggggaatta

SEQ ID NO: 1378 - DNA, 18 bp, Artificial Sequence
  Description of Artificial Sequence: Synthetic oligonucleotide
tcctcggcatctccacca

SEQ ID NO: 1379 - DNA, 24 bp, Artificial Sequence
  Description of Artificial Sequence: Synthetic oligonucleotide
tcatatgaagtcaccctagccatc

SEQ ID NO: 1380 - DNA, 21 bp, Artificial Sequence
  Description of Artificial Sequence: Synthetic oligonucleotide
tcagtttgtttattaacccaa

SEQ ID NO: 1381 - DNA, 18 bp, Artificial Sequence
  Description of Artificial Sequence: Synthetic oligonucleotide
tcagcgtgtctttgccct

SEQ ID NO: 1382 - DNA, 19 bp, Artificial Sequence
  Description of Artificial Sequence: Synthetic oligonucleotide
tcactggtggtctagtggt

SEQ ID NO: 1383 - DNA, 17 bp, Artificial Sequence
  Description of Artificial Sequence: Synthetic oligonucleotide
tcacaatgctgccacca

SEQ ID NO: 1384 - DNA, 19 bp, Artificial Sequence
  Description of Artificial Sequence: Synthetic oligonucleotide
tagttgttaattaacccaa

SEQ ID NO: 1385 - DNA, 18 bp, Artificial Sequence
  Description of Artificial Sequence: Synthetic oligonucleotide
tagtcctcatcgccctcc

SEQ ID NO: 1386 - DNA, 23 bp, Artificial Sequence
  Description of Artificial Sequence: Synthetic oligonucleotide
taaagtgcttatagtgcgggtaa

SEQ ID NO: 1387 - DNA, 18 bp, Artificial Sequence
  Description of Artificial Sequence: Synthetic oligonucleotide
gtcccaccagagtcgcca

SEQ ID NO: 1388 - DNA, 19 bp, Artificial Sequence
  Description of Artificial Sequence: Synthetic oligonucleotide
gggggaggggccaaaaaaa

SEQ ID NO: 1389 - DNA, 17 bp, Artificial Sequence
  Description of Artificial Sequence: Synthetic oligonucleotide
gggacgccgcggtgtcg

SEQ ID NO: 1390 - DNA, 24 bp, Artificial Sequence
  Description of Artificial Sequence: Synthetic oligonucleotide
gggaataccgggtgctttaggctt

SEQ ID NO: 1391 - DNA, 19 bp, Artificial Sequence
  Description of Artificial Sequence: Synthetic oligonucleotide
ggaagaaggtggtggtata

SEQ ID NO: 1392 - DNA, 15 bp, Artificial Sequence
  Description of Artificial Sequence: Synthetic oligonucleotide
gcggtgaaatgcgta

SEQ ID NO: 1393 - DNA, 17 bp, Artificial Sequence
  Description of Artificial Sequence: Synthetic oligonucleotide
gcggggaaggtggcaaa

SEQ ID NO: 1394 - DNA, 26 bp, Artificial Sequence
  Description of Artificial Sequence: Synthetic oligonucleotide
gcgacgacctcgcgcccacctggtca

SEQ ID NO: 1395 - DNA, 18 bp, Artificial Sequence
  Description of Artificial Sequence: Synthetic oligonucleotide
gccacccgatactgctgt

SEQ ID NO: 1396 - DNA, 21 bp, Artificial Sequence
  Description of Artificial Sequence: Synthetic oligonucleotide
gatgtatgctttgtttctgtt

SEQ ID NO: 1397 - DNA, 20 bp, Artificial Sequence
  Description of Artificial Sequence: Synthetic oligonucleotide
gagggggatttagaaaaaaa

SEQ ID NO: 1398 - DNA, 18 bp, Artificial Sequence
  Description of Artificial Sequence: Synthetic oligonucleotide
gaaggaaagttctatagt

SEQ ID NO: 1399 - DNA, 18 bp, Artificial Sequence
  Description of Artificial Sequence: Synthetic oligonucleotide
gaagcggctctcttattt

SEQ ID NO: 1400 - DNA, 22 bp, Artificial Sequence
  Description of Artificial Sequence: Synthetic oligonucleotide
gaacgagactctggcatgctga

SEQ ID NO: 1401 - DNA, 17 bp, Artificial Sequence
  Description of Artificial Sequence: Synthetic oligonucleotide
ctggtaggcccatcaat

SEQ ID NO: 1402 - DNA, 17 bp, Artificial Sequence
  Description of Artificial Sequence: Synthetic oligonucleotide
cggggccgatcgcgcgc

SEQ ID NO: 1403 - DNA, 18 bp, Artificial Sequence
  Description of Artificial Sequence: Synthetic oligonucleotide
cggccccgggttcctccc

SEQ ID NO: 1404 - DNA, 15 bp, Artificial Sequence
  Description of Artificial Sequence: Synthetic oligonucleotide
cgagcccggttagta

SEQ ID NO: 1405 - DNA, 17 bp, Artificial Sequence
  Description of Artificial Sequence: Synthetic oligonucleotide
cgactcttagcggtgga

SEQ ID NO: 1406 - DNA, 21 bp, Artificial Sequence
  Description of Artificial Sequence: Synthetic oligonucleotide
cgaatcccacttctgacacca

SEQ ID NO: 1407 - DNA, 17 bp, Artificial Sequence
  Description of Artificial Sequence: Synthetic oligonucleotide
cgaaagggaatcgggtc

SEQ ID NO: 1408 - DNA, 18 bp, Artificial Sequence
  Description of Artificial Sequence: Synthetic oligonucleotide
ccttaggtcgctggtaaa

SEQ ID NO: 1409 - DNA, 16 bp, Artificial Sequence
  Description of Artificial Sequence: Synthetic oligonucleotide
ccgtgcgagaatacca

SEQ ID NO: 1410 - DNA, 18 bp, Artificial Sequence
  Description of Artificial Sequence: Synthetic oligonucleotide
ccggtctctcaagcggcc

SEQ ID NO: 1411 - DNA, 18 bp, Artificial Sequence
  Description of Artificial Sequence: Synthetic oligonucleotide
cccggccctcgcgcgtcc

SEQ ID NO: 1412 - DNA, 17 bp, Artificial Sequence
  Description of Artificial Sequence: Synthetic oligonucleotide
ccccggcatttccacca

SEQ ID NO: 1413 - DNA, 20 bp, Artificial Sequence
  Description of Artificial Sequence: Synthetic oligonucleotide
cccccccggctcctccacca

SEQ ID NO: 1414 - DNA, 16 bp, Artificial Sequence
  Description of Artificial Sequence: Synthetic oligonucleotide
ccccccacaaccgcta

SEQ ID NO: 1415 - DNA, 19 bp, Artificial Sequence
  Description of Artificial Sequence: Synthetic oligonucleotide
cccaagtattgactcaccc

SEQ ID NO: 1416 - DNA, 16 bp, Artificial Sequence
  Description of Artificial Sequence: Synthetic oligonucleotide
ccagtaagcgcgagtc

SEQ ID NO: 1417 - DNA, 19 bp, Artificial Sequence
  Description of Artificial Sequence: Synthetic oligonucleotide
ccaaagaaagcacgtagag

SEQ ID NO: 1418 - DNA, 19 bp, Artificial Sequence
  Description of Artificial Sequence: Synthetic oligonucleotide
catgtttaacggccgcggt

SEQ ID NO: 1419 - DNA, 19 bp, Artificial Sequence
  Description of Artificial Sequence: Synthetic oligonucleotide
cagtttgtaattaacccaa

SEQ ID NO: 1420 - DNA, 16 bp, Artificial Sequence
  Description of Artificial Sequence: Synthetic oligonucleotide
caggaacggcgcacca

SEQ ID NO: 1421 - DNA, 19 bp, Artificial Sequence
  Description of Artificial Sequence: Synthetic oligonucleotide
cagaaccctctaaatcccc

SEQ ID NO: 1422 - DNA, 23 bp, Artificial Sequence
  Description of Artificial Sequence: Synthetic oligonucleotide
cacccggctgtgtgcacatgtgt

SEQ ID NO: 1423 - DNA, 18 bp, Artificial Sequence
  Description of Artificial Sequence: Synthetic oligonucleotide
caattggaccaatctatc

SEQ ID NO: 1424 - DNA, 17 bp, Artificial Sequence
  Description of Artificial Sequence: Synthetic oligonucleotide
attcctgtactgcgata

SEQ ID NO: 1425 - DNA, 18 bp, Artificial Sequence
  Description of Artificial Sequence: Synthetic oligonucleotide
atccctgcggcgtctcca

SEQ ID NO: 1426 - DNA, 18 bp, Artificial Sequence
  Description of Artificial Sequence: Synthetic oligonucleotide
atcccaccgctgccatca

SEQ ID NO: 1427 - DNA, 20 bp, Artificial Sequence
  Description of Artificial Sequence: Synthetic oligonucleotide
agtcaatagaagccggcgta

SEQ ID NO: 1428 - DNA, 17 bp, Artificial Sequence
  Description of Artificial Sequence: Synthetic oligonucleotide
aggttcgtttgtaaaaa

SEQ ID NO: 1429 - DNA, 19 bp, Artificial Sequence
  Description of Artificial Sequence: Synthetic oligonucleotide
aggtcctgggtttaagtgt

SEQ ID NO: 1430 - DNA, 19 bp, Artificial Sequence
  Description of Artificial Sequence: Synthetic oligonucleotide
agggggaagttctatagtc

SEQ ID NO: 1431 - DNA, 25 bp, Artificial Sequence
  Description of Artificial Sequence: Synthetic oligonucleotide
  modified_base (17)..(17): a, c, t, g, unknown or other
aggctgtgatgctctcntgagccct

SEQ ID NO: 1432 - DNA, 19 bp, Artificial Sequence
  Description of Artificial Sequence: Synthetic oligonucleotide
agcccctctccggccctta

SEQ ID NO: 1433 - DNA, 17 bp, Artificial Sequence
  Description of Artificial Sequence: Synthetic oligonucleotide
actaccacctacctccc

SEQ ID NO: 1434 - DNA, 21 bp, Artificial Sequence
  Description of Artificial Sequence: Synthetic oligonucleotide
acgcccttcccccccttcttt

SEQ ID NO: 1435 - DNA, 18 bp, Artificial Sequence
  Description of Artificial Sequence: Synthetic oligonucleotide
accccactcctggtgcac

SEQ ID NO: 1436 - DNA, 18 bp, Artificial Sequence
  Description of Artificial Sequence: Synthetic oligonucleotide
accacctgatcccttccc

SEQ ID NO: 1437 - DNA, 18 bp, Artificial Sequence
  Description of Artificial Sequence: Synthetic oligonucleotide
acagctaagcacccacca

SEQ ID NO: 1438 - DNA, 17 bp, Artificial Sequence
  Description of Artificial Sequence: Synthetic oligonucleotide
acacatgtttaacggcc

SEQ ID NO: 1439 - DNA, 17 bp, Artificial Sequence
  Description of Artificial Sequence: Synthetic oligonucleotide
aattagggacctgtatg

SEQ ID NO: 1440 - DNA, 21 bp, Artificial Sequence
  Description of Artificial Sequence: Synthetic oligonucleotide
aatggcccatttgggcaaaca

SEQ ID NO: 1441 - DNA, 18 bp, Artificial Sequence
  Description of Artificial Sequence: Synthetic oligonucleotide
aaagcggctgtgcaaaca

SEQ ID NO: 1442 - DNA, 18 bp, Artificial Sequence
  Description of Artificial Sequence: Synthetic oligonucleotide
atcctgccgactacgcca

SEQ ID NO: 1443 - DNA, 22 bp, Artificial Sequence
  Description of Artificial Sequence: Synthetic oligonucleotide
tcgaatcccactcctgacacca

SEQ ID NO: 1444 - DNA, 18 bp, Artificial Sequence
  Description of Artificial Sequence: Synthetic oligonucleotide
atcccatcctcgtcgcca

SEQ ID NO: 1445 - DNA, 22 bp, Artificial Sequence
  Description of Artificial Sequence: Synthetic oligonucleotide
tcgattccccgacggggagcca

SEQ ID NO: 1446 - DNA, 18 bp, Artificial Sequence
  Description of Artificial Sequence: Synthetic oligonucleotide
atccgggtgccccctcca

SEQ ID NO: 1447 - DNA, 22 bp, Artificial Sequence
  Description of Artificial Sequence: Synthetic oligonucleotide
tcgactcctggctggctcgcca

SEQ ID NO: 1448 - DNA, 17 bp, Artificial Sequence
  Description of Artificial Sequence: Synthetic oligonucleotide
tcccgggcggcgcacca

SEQ ID NO: 1449 - DNA, 18 bp, Artificial Sequence
  Description of Artificial Sequence: Synthetic oligonucleotide
atcccaccagagtcgcca

SEQ ID NO: 1450 - DNA, 19 bp, Artificial Sequence
  Description of Artificial Sequence: Synthetic oligonucleotide
tccccggcatctccaccaa

SEQ ID NO: 1451 - DNA, 22 bp, Artificial Sequence
  Description of Artificial Sequence: Synthetic oligonucleotide
tcaaatcacgtcggggtcacca

SEQ ID NO: 1452 - DNA, 25 bp, Artificial Sequence
  Description of Artificial Sequence: Synthetic oligonucleotide
gcggtggatcactcggctcgtgcgt

SEQ ID NO: 1453 - DNA, 22 bp, Artificial Sequence
  Description of Artificial Sequence: Synthetic oligonucleotide
tcgatccccgtacgggccacca

SEQ ID NO: 1454 - DNA, 22 bp, Artificial Sequence
  Description of Artificial Sequence: Synthetic oligonucleotide
tcgagcctcacctggagcacca

SEQ ID NO: 1455 - DNA, 17 bp, Artificial Sequence
  Description of Artificial Sequence: Synthetic oligonucleotide
tccggctcgaaggacca

SEQ ID NO: 1456 - DNA, 14 bp, Artificial Sequence
  Description of Artificial Sequence: Synthetic oligonucleotide
ccgggtgttgtaga

SEQ ID NO: 1457 - DNA, 19 bp, Artificial Sequence
  Description of Artificial Sequence: Synthetic oligonucleotide
tgtagcgtggccgagcggt

SEQ ID NO: 1458 - DNA, 19 bp, Artificial Sequence
  Description of Artificial Sequence: Synthetic oligonucleotide
tggggcgacctcggagcag

SEQ ID NO: 1459 - DNA, 27 bp, Artificial Sequence
  Description of Artificial Sequence: Synthetic oligonucleotide
tggcgtcctaagccagggattgtgggt

SEQ ID NO: 1460 - DNA, 23 bp, Artificial Sequence
  Description of Artificial Sequence: Synthetic oligonucleotide
tggcaggggagataccatgattt

SEQ ID NO: 1461 - DNA, 19 bp, Artificial Sequence
  Description of Artificial Sequence: Synthetic oligonucleotide
tctgatcagggtgagcatc

SEQ ID NO: 1462 - DNA, 17 bp, Artificial Sequence
  Description of Artificial Sequence: Synthetic oligonucleotide
tcgtaggcaccatccat

SEQ ID NO: 1463 - DNA, 19 bp, Artificial Sequence
  Description of Artificial Sequence: Synthetic oligonucleotide
gggaaacggggcgcggctg

SEQ ID NO: 1464 - DNA, 24 bp, Artificial Sequence
  Description of Artificial Sequence: Synthetic oligonucleotide
ctactcctgctcgcatctgctata

SEQ ID NO: 1465 - DNA, 18 bp, Artificial Sequence
  Description of Artificial Sequence: Synthetic oligonucleotide
cgggtgggtttttaccgg

SEQ ID NO: 1466 - DNA, 18 bp, Artificial Sequence
  Description of Artificial Sequence: Synthetic oligonucleotide
cgaggaattcccagtaag

SEQ ID NO: 1467 - DNA, 19 bp, Artificial Sequence
  Description of Artificial Sequence: Synthetic oligonucleotide
cgaacgcacttgcggcccc

SEQ ID NO: 1468 - DNA, 19 bp, Artificial Sequence
  Description of Artificial Sequence: Synthetic oligonucleotide
ccccgcgcgggttcgaatc

SEQ ID NO: 1469 - DNA, 19 bp, Artificial Sequence
  Description of Artificial Sequence: Synthetic oligonucleotide
aggggtatgattcccgctt

SEQ ID NO: 1470 - DNA, 18 bp, Artificial Sequence
  Description of Artificial Sequence: Synthetic oligonucleotide
cggggccacgcgcgcgtc

SEQ ID NO: 1471 - DNA, 18 bp, Artificial Sequence
  Description of Artificial Sequence: Synthetic oligonucleotide
tggcgctgcgggatgaac

SEQ ID NO: 1472 - DNA, 27 bp, Artificial Sequence
  Description of Artificial Sequence: Synthetic oligonucleotide
ccccccactgctaaatttgactggctt

SEQ ID NO: 1473 - DNA, 19 bp, Artificial Sequence
  Description of Artificial Sequence: Synthetic oligonucleotide
taaaggttcgtttgtaaaa

SEQ ID NO: 1474 - DNA, 17 bp, Artificial Sequence
  Description of Artificial Sequence: Synthetic oligonucleotide
cggggccgagggagcga

SEQ ID NO: 1475 - DNA, 16 bp, Artificial Sequence
  Description of Artificial Sequence: Synthetic oligonucleotide
gggttaggcctctttt

SEQ ID NO: 1476 - DNA, 17 bp, Artificial Sequence
  Description of Artificial Sequence: Synthetic oligonucleotide
ctgcggaaggatcatta

SEQ ID NO: 1477 - DNA, 14 bp, Artificial Sequence
  Description of Artificial Sequence: Synthetic oligonucleotide
ccctacccccccgg

SEQ ID NO: 1478 - DNA, 16 bp, Artificial Sequence
  Description of Artificial Sequence: Synthetic oligonucleotide
cccgccgggtccgccc

SEQ ID NO: 1479 - DNA, 20 bp, Artificial Sequence
  Description of Artificial Sequence: Synthetic oligonucleotide
ccccgcgccctctctctctc

SEQ ID NO: 1480 - DNA, 17 bp, Artificial Sequence
  Description of Artificial Sequence: Synthetic oligonucleotide
caggcctccctggaatc

SEQ ID NO: 1481 - DNA, 19 bp, Artificial Sequence
  Description of Artificial Sequence: Synthetic oligonucleotide
agtcccacccggggtacca

SEQ ID NO: 1482 - DNA, 22 bp, Artificial Sequence
  Description of Artificial Sequence: Synthetic oligonucleotide
ttgacacgccccagtgccctgt

SEQ ID NO: 1483 - DNA, 19 bp, Artificial Sequence
  Description of Artificial Sequence: Synthetic oligonucleotide
tgggagcgggcgggcggtc

SEQ ID NO: 1484 - DNA, 18 bp, Artificial Sequence
  Description of Artificial Sequence: Synthetic oligonucleotide
tggcgtggagccgggcgt

SEQ ID NO: 1485 - DNA, 17 bp, Artificial Sequence
  Description of Artificial Sequence: Synthetic oligonucleotide
tggaggtccgtagcggt

SEQ ID NO: 1486 - DNA, 18 bp, Artificial Sequence
  Description of Artificial Sequence: Synthetic oligonucleotide
tgaagaaggtctcgaaca

SEQ ID NO: 1487 - DNA, 17 bp, Artificial Sequence
  Description of Artificial Sequence: Synthetic oligonucleotide
tctcgccggggcttcca

SEQ ID NO: 1488 - DNA, 18 bp, Artificial Sequence
  Description of Artificial Sequence: Synthetic oligonucleotide
tcgtagcaccatcaataa

SEQ ID NO: 1489 - DNA, 17 bp, Artificial Sequence
  Description of Artificial Sequence: Synthetic oligonucleotide
tccgggtcccccctcca

SEQ ID NO: 1490 - DNA, 20 bp, Artificial Sequence
  Description of Artificial Sequence: Synthetic oligonucleotide
tccggggctgcacgcgcgct

SEQ ID NO: 1491 - DNA, 15 bp, Artificial Sequence
  Description of Artificial Sequence: Synthetic oligonucleotide
tccggccgtgtcggt

SEQ ID NO: 1492 - DNA, 18 bp, Artificial Sequence
  Description of Artificial Sequence: Synthetic oligonucleotide
tccctgtcctccaggagt

SEQ ID NO: 1493 - DNA, 17 bp, Artificial Sequence
  Description of Artificial Sequence: Synthetic oligonucleotide
tcccctcctcgtcgcca

SEQ ID NO: 1494 - DNA, 19 bp, Artificial Sequence
  Description of Artificial Sequence: Synthetic oligonucleotide
tcccaggtagtctagtggt

SEQ ID NO: 1495 - DNA, 22 bp, Artificial Sequence
  Description of Artificial Sequence: Synthetic oligonucleotide
tattcatttatccccagcctat

SEQ ID NO: 1496 - DNA, 17 bp, Artificial Sequence
  Description of Artificial Sequence: Synthetic oligonucleotide
tagttgttataacccaa

SEQ ID NO: 1497 - DNA, 17 bp, Artificial Sequence
  Description of Artificial Sequence: Synthetic oligonucleotide
tagatcaccccctcccc

SEQ ID NO: 1498 - DNA, 17 bp, Artificial Sequence
  Description of Artificial Sequence: Synthetic oligonucleotide
taccggcacctggcgcc

SEQ ID NO: 1499 - DNA, 17 bp, Artificial Sequence
  Description of Artificial Sequence: Synthetic oligonucleotide
gtataggggcgaaagac

SEQ ID NO: 1500 - DNA, 19 bp, Artificial Sequence
  Description of Artificial Sequence: Synthetic oligonucleotide
gtagctggttccctccgaa

SEQ ID NO: 1501 - DNA, 17 bp, Artificial Sequence
  Description of Artificial Sequence: Synthetic oligonucleotide
ggtaagaagcccggctc

SEQ ID NO: 1502 - DNA, 19 bp, Artificial Sequence
  Description of Artificial Sequence: Synthetic oligonucleotide
gggggggtttaaaaaaaaa

SEQ ID NO: 1503 - DNA, 17 bp, Artificial Sequence
  Description of Artificial Sequence: Synthetic oligonucleotide
ggggcgcactaccggcc

SEQ ID NO: 1504 - DNA, 19 bp, Artificial Sequence
  Description of Artificial Sequence: Synthetic oligonucleotide
gggagaggctgtcgctgcg

SEQ ID NO: 1505 - DNA, 16 bp, Artificial Sequence
  Description of Artificial Sequence: Synthetic oligonucleotide
ggcgggtgaagcggcg

SEQ ID NO: 1506 - DNA, 17 bp, Artificial Sequence
  Description of Artificial Sequence: Synthetic oligonucleotide
gcggttccggcggcgtc

SEQ ID NO: 1507 - DNA, 24 bp, Artificial Sequence
  Description of Artificial Sequence: Synthetic oligonucleotide
gcggggcgcctaggcctggtttgt

SEQ ID NO: 1508 - DNA, 22 bp, Artificial Sequence
  Description of Artificial Sequence: Synthetic oligonucleotide
gcggcggtcggcgggcggcggg

SEQ ID NO: 1509 - DNA, 21 bp, Artificial Sequence
  Description of Artificial Sequence: Synthetic oligonucleotide
gagggggggggtgggggggga

SEQ ID NO: 1510 - DNA, 17 bp, Artificial Sequence
  Description of Artificial Sequence: Synthetic oligonucleotide
ctgtcggccaccatcat

SEQ ID NO: 1511 - DNA, 16 bp, Artificial Sequence
  Description of Artificial Sequence: Synthetic oligonucleotide
ctgcaactcgacccca

SEQ ID NO: 1512 - DNA, 19 bp, Artificial Sequence
  Description of Artificial Sequence: Synthetic oligonucleotide
ctcctctccccgcccgccg

SEQ ID NO: 1513 - DNA, 26 bp, Artificial Sequence
  Description of Artificial Sequence: Synthetic oligonucleotide
ctcaaagattaagccatgcatgtcta

SEQ ID NO: 1514 - DNA, 15 bp, Artificial Sequence
  Description of Artificial Sequence: Synthetic oligonucleotide
ctacgccgcgacgag

SEQ ID NO: 1515 - DNA, 22 bp, Artificial Sequence
  Description of Artificial Sequence: Synthetic oligonucleotide
cgggtgacggggaatcagggtt

SEQ ID NO: 1516 - DNA, 16 bp, Artificial Sequence
  Description of Artificial Sequence: Synthetic oligonucleotide
cgggcagcttccggga

SEQ ID NO: 1517 - DNA, 18 bp, Artificial Sequence
  Description of Artificial Sequence: Synthetic oligonucleotide
cgggaggcccgggtcctg

SEQ ID NO: 1518 - DNA, 17 bp, Artificial Sequence
  Description of Artificial Sequence: Synthetic oligonucleotide
cggccccgcatcctccc

SEQ ID NO: 1519 - DNA, 26 bp, Artificial Sequence
  Description of Artificial Sequence: Synthetic oligonucleotide
cgcgggtaaacggcgggagtaactat

SEQ ID NO: 1520 - DNA, 20 bp, Artificial Sequence
  Description of Artificial Sequence: Synthetic oligonucleotide
cgccccccgttcccccctcc

SEQ ID NO: 1521 - DNA, 15 bp, Artificial Sequence
  Description of Artificial Sequence: Synthetic oligonucleotide
cgagcggaaacacca

SEQ ID NO: 1522 - DNA, 15 bp, Artificial Sequence
  Description of Artificial Sequence: Synthetic oligonucleotide
cgaacccggcaccgc

SEQ ID NO: 1523 - DNA, 17 bp, Artificial Sequence
  Description of Artificial Sequence: Synthetic oligonucleotide
cctcgggccgatcgcac

SEQ ID NO: 1524 - DNA, 16 bp, Artificial Sequence
  Description of Artificial Sequence: Synthetic oligonucleotide
cctatatatcttacca

SEQ ID NO: 1525 - DNA, 17 bp, Artificial Sequence
  Description of Artificial Sequence: Synthetic oligonucleotide
ccgtggcggcgacgacc

SEQ ID NO: 1526 - DNA, 16 bp, Artificial Sequence
  Description of Artificial Sequence: Synthetic oligonucleotide
ccgggttccggcacca

SEQ ID NO: 1527 - DNA, 16 bp, Artificial Sequence
  Description of Artificial Sequence: Synthetic oligonucleotide
ccgcgaggggggcccg

SEQ ID NO: 1528 - DNA, 16 bp, Artificial Sequence
  Description of Artificial Sequence: Synthetic oligonucleotide
ccgcctcacgggacca

SEQ ID NO: 1529 - DNA, 20 bp, Artificial Sequence
  Description of Artificial Sequence: Synthetic oligonucleotide
ccgcccgtccccgccccttg

SEQ ID NO: 1530 - DNA, 18 bp, Artificial Sequence
  Description of Artificial Sequence: Synthetic oligonucleotide
cccggggccgcggttccg

SEQ ID NO: 1531 - DNA, 16 bp, Artificial Sequence
  Description of Artificial Sequence: Synthetic oligonucleotide
cccgagccgcctggat

SEQ ID NO: 1532 - DNA, 15 bp, Artificial Sequence
  Description of Artificial Sequence: Synthetic oligonucleotide
cccgacggccgaact

SEQ ID NO: 1533 - DNA, 19 bp, Artificial Sequence
  Description of Artificial Sequence: Synthetic oligonucleotide
ccccggggagcccggcggg

SEQ ID NO: 1534 - DNA, 19 bp, Artificial Sequence
  Description of Artificial Sequence: Synthetic oligonucleotide
ccccctcgcggccctcccc

SEQ ID NO: 1535 - DNA, 17 bp, Artificial Sequence
  Description of Artificial Sequence: Synthetic oligonucleotide
ccccccgtggcggcgac

SEQ ID NO: 1536 - DNA, 17 bp, Artificial Sequence
  Description of Artificial Sequence: Synthetic oligonucleotide
ccacccagggcacgcca

SEQ ID NO: 1537 - DNA, 16 bp, Artificial Sequence
  Description of Artificial Sequence: Synthetic oligonucleotide
cacgggtgacggggaa

SEQ ID NO: 1538 - DNA, 23 bp, Artificial Sequence
  Description of Artificial Sequence: Synthetic oligonucleotide
atggggaggaaaaaaaaaaaaaa

SEQ ID NO: 1539 - DNA, 18 bp, Artificial Sequence
  Description of Artificial Sequence: Synthetic oligonucleotide
atcccaccgctgccccca

SEQ ID NO: 1540 - DNA, 16 bp, Artificial Sequence
  Description of Artificial Sequence: Synthetic oligonucleotide
atcacgtcggtcacca

SEQ ID NO: 1541 - DNA, 23 bp, Artificial Sequence
  Description of Artificial Sequence: Synthetic oligonucleotide
acgggaaacctcacccggcccgg

SEQ ID NO: 1542 - DNA, 24 bp, Artificial Sequence
  Description of Artificial Sequence: Synthetic oligonucleotide
acagaggcttacgaccccttattt

SEQ ID NO: 1543 - DNA, 20 bp, Artificial Sequence
  Description of Artificial Sequence: Synthetic oligonucleotide
aaaaaggcataattaaactt

SEQ ID NO: 1544 - DNA, 23 bp, Artificial Sequence
  Description of Artificial Sequence: Synthetic oligonucleotide
tggctcagttcagcaggaacagt

SEQ ID NO: 1545 - DNA, 19 bp, Artificial Sequence
  Description of Artificial Sequence: Synthetic oligonucleotide
gtgggggagaggctgtcga

SEQ ID NO: 1546 - DNA, 22 bp, Artificial Sequence
  Description of Artificial Sequence: Synthetic oligonucleotide
cggggcagctcagtacaggatt

SEQ ID NO: 1547 - DNA, 23 bp, Artificial Sequence
  Description of Artificial Sequence: Synthetic oligonucleotide
aattgcacggtatccatctgtat

SEQ ID NO: 1548 - DNA, 23 bp, Artificial Sequence
  Description of Artificial Sequence: Synthetic oligonucleotide
tgtcagtttgttaattgacccaa

SEQ ID NO: 1549 - DNA, 18 bp, Artificial Sequence
  Description of Artificial Sequence: Synthetic oligonucleotide
ggcaatacgagcaccctg

SEQ ID NO: 1550 - DNA, 17 bp, Artificial Sequence
  Description of Artificial Sequence: Synthetic oligonucleotide
cgggggagcgccgcgta

SEQ ID NO: 1551 - DNA, 16 bp, Artificial Sequence
  Description of Artificial Sequence: Synthetic oligonucleotide
ccggggcgtctcgtac

SEQ ID NO: 1552 - DNA, 16 bp, Artificial Sequence
  Description of Artificial Sequence: Synthetic oligonucleotide
agcggctgtgcacaaa

SEQ ID NO: 1553 - DNA, 20 bp, Artificial Sequence
  Description of Artificial Sequence: Synthetic oligonucleotide
tgtcagtttgtttaatccaa

SEQ ID NO: 1554 - DNA, 20 bp, Artificial Sequence
  Description of Artificial Sequence: Synthetic oligonucleotide
tgtcagtttgttattaccaa

SEQ ID NO: 1555 - DNA, 19 bp, Artificial Sequence
  Description of Artificial Sequence: Synthetic oligonucleotide
tgtcaggcaccatcaataa

SEQ ID NO: 1556 - DNA, 20 bp, Artificial Sequence
  Description of Artificial Sequence: Synthetic oligonucleotide
tgatcttgacacttaaagcc

SEQ ID NO: 1557 - DNA, 17 bp, Artificial Sequence
  Description of Artificial Sequence: Synthetic oligonucleotide
tcgtaggcaccatcaat

SEQ ID NO: 1558 - DNA, 22 bp, Artificial Sequence
  Description of Artificial Sequence: Synthetic oligonucleotide
tcgatcccgggtttcggcacca

SEQ ID NO: 1559 - DNA, 22 bp, Artificial Sequence
  Description of Artificial Sequence: Synthetic oligonucleotide
tcgactcccggtatgggaacca

SEQ ID NO: 1560 - DNA, 23 bp, Artificial Sequence
  Description of Artificial Sequence: Synthetic oligonucleotide
tagggaggttatgattaactttt

SEQ ID NO: 1561 - DNA, 20 bp, Artificial Sequence
  Description of Artificial Sequence: Synthetic oligonucleotide
taaagtgcttagtgcaggta

SEQ ID NO: 1562 - DNA, 19 bp, Artificial Sequence
  Description of Artificial Sequence: Synthetic oligonucleotide
gtttatgttgcttacctcc

SEQ ID NO: 1563 - DNA, 18 bp, Artificial Sequence
  Description of Artificial Sequence: Synthetic oligonucleotide
gtagataaaatattggcg

SEQ ID NO: 1564 - DNA, 17 bp, Artificial Sequence
  Description of Artificial Sequence: Synthetic oligonucleotide
ggcggggacgacgtcag

SEQ ID NO: 1565 - DNA, 19 bp, Artificial Sequence
  Description of Artificial Sequence: Synthetic oligonucleotide
ggcggcgtcgcggcgggtc

SEQ ID NO: 1566 - DNA, 24 bp, Artificial Sequence
  Description of Artificial Sequence: Synthetic oligonucleotide
ggagggggtgaacaaaaagaaaaa

SEQ ID NO: 1567 - DNA, 29 bp, Artificial Sequence
  Description of Artificial Sequence: Synthetic oligonucleotide
gctaaacctagccccaaacccactccaca

SEQ ID NO: 1568 - DNA, 19 bp, Artificial Sequence
  Description of Artificial Sequence: Synthetic oligonucleotide
ctggatagcgcacttcgtt

SEQ ID NO: 1569 - DNA, 21 bp, Artificial Sequence
  Description of Artificial Sequence: Synthetic oligonucleotide
cgggcgaggggcggacgttcg

SEQ ID NO: 1570 - DNA, 15 bp, Artificial Sequence
  Description of Artificial Sequence: Synthetic oligonucleotide
cggacctataccgga

SEQ ID NO: 1571 - DNA, 30 bp, Artificial Sequence; identical to SEQ ID NO: 679
  Description of Artificial Sequence: Synthetic oligonucleotide

SEQ ID NO: 1572 - DNA, 17 bp, Artificial Sequence
  Description of Artificial Sequence: Synthetic oligonucleotide
ccccccacaaccgcgaa

SEQ ID NO: 1573 - DNA, 20 bp, Artificial Sequence
  Description of Artificial Sequence: Synthetic oligonucleotide
cccagcatctcctgtgttta

SEQ ID NO: 1574 - DNA, 17 bp, Artificial Sequence
  Description of Artificial Sequence: Synthetic oligonucleotide
cccacgttgggacgcca

SEQ ID NO: 1575 - DNA, 23 bp, Artificial Sequence
  Description of Artificial Sequence: Synthetic oligonucleotide
atcgtatcccacttctgacacca

SEQ ID NO: 1576 - DNA, 18 bp, Artificial Sequence
  Description of Artificial Sequence: Synthetic oligonucleotide
atcacgtccgtgcctcca

SEQ ID NO: 1577 - DNA, 21 bp, Artificial Sequence
  Description of Artificial Sequence: Synthetic oligonucleotide
atagcaatgtcagcagtacct

SEQ ID NO: 1578 - DNA, 18 bp, Artificial Sequence
  Description of Artificial Sequence: Synthetic oligonucleotide
accctgctcgctgcgcca

SEQ ID NO: 1579 - DNA, 18 bp, Artificial Sequence
  Description of Artificial Sequence: Synthetic oligonucleotide
tcccacccagggacgcca

SEQ ID NO: 1580 - DNA, 17 bp, Artificial Sequence
  Description of Artificial Sequence: Synthetic oligonucleotide
tcgtaggcacatcaata

SEQ ID NO: 1581 - DNA, 16 bp, Artificial Sequence
  Description of Artificial Sequence: Synthetic oligonucleotide
cccccacaaccgcgta

SEQ ID NO: 1582 - DNA, 18 bp, Artificial Sequence
  Description of Artificial Sequence: Synthetic oligonucleotide
accccgtccgtgcctcca

SEQ ID NO: 1583 - DNA, 19 bp, Artificial Sequence
  Description of Artificial Sequence: Synthetic oligonucleotide
aaaaaagacaccccccaca

SEQ ID NO: 1584 - DNA, 19 bp, Artificial Sequence
  Description of Artificial Sequence: Synthetic oligonucleotide
tgtcagtttgttaacccaa

SEQ ID NO: 1585 - DNA, 22 bp, Artificial Sequence
  Description of Artificial Sequence: Synthetic oligonucleotide
tccctgtggtctagtggttagg

SEQ ID NO: 1586 - DNA, 15 bp, Artificial Sequence
  Description of Artificial Sequence: Synthetic oligonucleotide
gggggggtaaaaaaa

SEQ ID NO: 1587 - DNA, 16 bp, Artificial Sequence
  Description of Artificial Sequence: Synthetic oligonucleotide
ggggggggaaaaaaaa

SEQ ID NO: 1588 - DNA, 17 bp, Artificial Sequence
  Description of Artificial Sequence: Synthetic oligonucleotide
cgggcccgggtcttccc

SEQ ID NO: 1589 - DNA, 19 bp, Artificial Sequence
  Description of Artificial Sequence: Synthetic oligonucleotide
ccgccccccgttcccccca

SEQ ID NO: 1590 - DNA, 19 bp, Artificial Sequence
  Description of Artificial Sequence: Synthetic oligonucleotide
acccccggctcctccacca

SEQ ID NO: 1591 - DNA, 19 bp, Artificial Sequence
  Description of Artificial Sequence: Synthetic oligonucleotide
tttggtggaaattttttga

SEQ ID NO: 1592 - DNA, 19 bp, Artificial Sequence
  Description of Artificial Sequence: Synthetic oligonucleotide
tgtcagtttgttataccaa

SEQ ID NO: 1593 - DNA, 22 bp, Artificial Sequence
  Description of Artificial Sequence: Synthetic oligonucleotide
tgtcagtttgtaattatcccaa

SEQ ID NO: 1594 - DNA, 18 bp, Artificial Sequence
  Description of Artificial Sequence: Synthetic oligonucleotide
tgtcaatttttaacccaa

SEQ ID NO: 1595 - DNA, 19 bp, Artificial Sequence
  Description of Artificial Sequence: Synthetic oligonucleotide
tgctagggtaaaaaaaaaa

SEQ ID NO: 1596 - DNA, 23 bp, Artificial Sequence
  Description of Artificial Sequence: Synthetic oligonucleotide
tgcaactccaaataaaagtacca

SEQ ID NO: 1597 - DNA, 18 bp, Artificial Sequence
  Description of Artificial Sequence: Synthetic oligonucleotide
tgaggtaacggggaatta

SEQ ID NO: 1598 - DNA, 18 bp, Artificial Sequence
  Description of Artificial Sequence: Synthetic oligonucleotide
tcctcggcatctccacca

SEQ ID NO: 1599 - DNA, 24 bp, Artificial Sequence
  Description of Artificial Sequence: Synthetic oligonucleotide
tcatatgaagtcaccctagccatc

SEQ ID NO: 1600 - DNA, 21 bp, Artificial Sequence
  Description of Artificial Sequence: Synthetic oligonucleotide
tcagtttgtttattaacccaa

SEQ ID NO: 1601 - DNA, 18 bp, Artificial Sequence
  Description of Artificial Sequence: Synthetic oligonucleotide
tcagcgtgtctttgccct

SEQ ID NO: 1602 - DNA, 19 bp, Artificial Sequence
  Description of Artificial Sequence: Synthetic oligonucleotide
tcactggtggtctagtggt

SEQ ID NO: 1603 - DNA, 17 bp, Artificial Sequence
  Description of Artificial Sequence: Synthetic oligonucleotide
tcacaatgctgccacca

SEQ ID NO: 1604 - DNA, 19 bp, Artificial Sequence
  Description of Artificial Sequence: Synthetic oligonucleotide
tagttgttaattaacccaa

SEQ ID NO: 1605 - DNA, 18 bp, Artificial Sequence
  Description of Artificial Sequence: Synthetic oligonucleotide
tagtcctcatcgccctcc

SEQ ID NO: 1606 - DNA, 23 bp, Artificial Sequence
  Description of Artificial Sequence: Synthetic oligonucleotide
taaagtgcttatagtgcgggtaa

SEQ ID NO: 1607 - DNA, 18 bp, Artificial Sequence
  Description of Artificial Sequence: Synthetic oligonucleotide
gtcccaccagagtcgcca

SEQ ID NO: 1608 - DNA, 19 bp, Artificial Sequence
  Description of Artificial Sequence: Synthetic oligonucleotide
gggggaggggccaaaaaaa

SEQ ID NO: 1609 - DNA, 17 bp, Artificial Sequence
  Description of Artificial Sequence: Synthetic oligonucleotide
gggacgccgcggtgtcg

SEQ ID NO: 1610 - DNA, 24 bp, Artificial Sequence
  Description of Artificial Sequence: Synthetic oligonucleotide
gggaataccgggtgctttaggctt

SEQ ID NO: 1611 - DNA, 19 bp, Artificial Sequence
  Description of Artificial Sequence: Synthetic oligonucleotide
ggaagaaggtggtggtata

SEQ ID NO: 1612 - DNA, 15 bp, Artificial Sequence
  Description of Artificial Sequence: Synthetic oligonucleotide
gcggtgaaatgcgta

SEQ ID NO: 1613 - DNA, 17 bp, Artificial Sequence
  Description of Artificial Sequence: Synthetic oligonucleotide
gcggggaaggtggcaaa

SEQ ID NO: 1614 - DNA, 26 bp, Artificial Sequence
  Description of Artificial Sequence: Synthetic oligonucleotide
gcgacgacctcgcgcccacctggtca

SEQ ID NO: 1615 - DNA, 18 bp, Artificial Sequence
  Description of Artificial Sequence: Synthetic oligonucleotide
gccacccgatactgctgt

SEQ ID NO: 1616 - DNA, 21 bp, Artificial Sequence
  Description of Artificial Sequence: Synthetic oligonucleotide
gatgtatgctttgtttctgtt

SEQ ID NO: 1617 - DNA, 20 bp, Artificial Sequence
  Description of Artificial Sequence: Synthetic oligonucleotide
gagggggatttagaaaaaaa

SEQ ID NO: 1618 - DNA, 18 bp, Artificial Sequence
  Description of Artificial Sequence: Synthetic oligonucleotide
gaaggaaagttctatagt

SEQ ID NO: 1619 - DNA, 18 bp, Artificial Sequence
  Description of Artificial Sequence: Synthetic oligonucleotide
gaagcggctctcttattt

SEQ ID NO: 1620 - DNA, 22 bp, Artificial Sequence
  Description of Artificial Sequence: Synthetic oligonucleotide
gaacgagactctggcatgctga

SEQ ID NO: 1621 - DNA, 17 bp, Artificial Sequence
  Description of Artificial Sequence: Synthetic oligonucleotide
ctggtaggcccatcaat

SEQ ID NO: 1622 - DNA, 17 bp, Artificial Sequence
  Description of Artificial Sequence: Synthetic oligonucleotide
cggggccgatcgcgcgc

SEQ ID NO: 1623 - DNA, 18 bp, Artificial Sequence
  Description of Artificial Sequence: Synthetic oligonucleotide
cggccccgggttcctccc

SEQ ID NO: 1624 - DNA, 15 bp, Artificial Sequence
  Description of Artificial Sequence: Synthetic oligonucleotide
cgagcccggttagta

SEQ ID NO: 1625 - DNA, 17 bp, Artificial Sequence
  Description of Artificial Sequence: Synthetic oligonucleotide
cgactcttagcggtgga

SEQ ID NO: 1626 - DNA, 21 bp, Artificial Sequence
  Description of Artificial Sequence: Synthetic oligonucleotide
cgaatcccacttctgacacca

SEQ ID NO: 1627 - DNA, 17 bp, Artificial Sequence
  Description of Artificial Sequence: Synthetic oligonucleotide
cgaaagggaatcgggtc

SEQ ID NO: 1628 - DNA, 18 bp, Artificial Sequence
  Description of Artificial Sequence: Synthetic oligonucleotide
ccttaggtcgctggtaaa

SEQ ID NO: 1629 - DNA, 16 bp, Artificial Sequence
  Description of Artificial Sequence: Synthetic oligonucleotide
ccgtgcgagaatacca

SEQ ID NO: 1630 - DNA, 18 bp, Artificial Sequence
  Description of Artificial Sequence: Synthetic oligonucleotide
ccggtctctcaagcggcc

SEQ ID NO: 1631 - DNA, 18 bp, Artificial Sequence
  Description of Artificial Sequence: Synthetic oligonucleotide
cccggccctcgcgcgtcc

SEQ ID NO: 1632 - DNA, 17 bp, Artificial Sequence
  Description of Artificial Sequence: Synthetic oligonucleotide
ccccggcatttccacca

SEQ ID NO: 1633 - DNA, 20 bp, Artificial Sequence
  Description of Artificial Sequence: Synthetic oligonucleotide
cccccccggctcctccacca

SEQ ID NO: 1634 - DNA, 16 bp, Artificial Sequence
  Description of Artificial Sequence: Synthetic oligonucleotide
ccccccacaaccgcta

SEQ ID NO: 1635 - DNA, 19 bp, Artificial Sequence
  Description of Artificial Sequence: Synthetic oligonucleotide
cccaagtattgactcaccc

SEQ ID NO: 1636 - DNA, 16 bp, Artificial Sequence
  Description of Artificial Sequence: Synthetic oligonucleotide
ccagtaagcgcgagtc

SEQ ID NO: 1637 - DNA, 19 bp, Artificial Sequence
  Description of Artificial Sequence: Synthetic oligonucleotide
ccaaagaaagcacgtagag

SEQ ID NO: 1638 - DNA, 19 bp, Artificial Sequence
  Description of Artificial Sequence: Synthetic oligonucleotide
catgtttaacggccgcggt

SEQ ID NO: 1639 - DNA, 19 bp, Artificial Sequence
  Description of Artificial Sequence: Synthetic oligonucleotide
cagtttgtaattaacccaa

SEQ ID NO: 1640 - DNA, 16 bp, Artificial Sequence
  Description of Artificial Sequence: Synthetic oligonucleotide
caggaacggcgcacca

SEQ ID NO: 1641 - DNA, 19 bp, Artificial Sequence
  Description of Artificial Sequence: Synthetic oligonucleotide
cagaaccctctaaatcccc

SEQ ID NO: 1642 - DNA, 23 bp, Artificial Sequence
  Description of Artificial Sequence: Synthetic oligonucleotide
cacccggctgtgtgcacatgtgt

SEQ ID NO: 1643 - DNA, 18 bp, Artificial Sequence
  Description of Artificial Sequence: Synthetic oligonucleotide
caattggaccaatctatc

SEQ ID NO: 1644 - DNA, 17 bp, Artificial Sequence
  Description of Artificial Sequence: Synthetic oligonucleotide
attcctgtactgcgata

SEQ ID NO: 1645 - DNA, 18 bp, Artificial Sequence
  Description of Artificial Sequence: Synthetic oligonucleotide
atccctgcggcgtctcca

SEQ ID NO: 1646 - DNA, 18 bp, Artificial Sequence
  Description of Artificial Sequence: Synthetic oligonucleotide
atcccaccgctgccatca

SEQ ID NO: 1647 - DNA, 20 bp, Artificial Sequence
  Description of Artificial Sequence: Synthetic oligonucleotide
agtcaatagaagccggcgta

SEQ ID NO: 1648 - DNA, 17 bp, Artificial Sequence
  Description of Artificial Sequence: Synthetic oligonucleotide
aggttcgtttgtaaaaa

SEQ ID NO: 1649 - DNA, 19 bp, Artificial Sequence
  Description of Artificial Sequence: Synthetic oligonucleotide
aggtcctgggtttaagtgt

SEQ ID NO: 1650 - DNA, 19 bp, Artificial Sequence
  Description of Artificial Sequence: Synthetic oligonucleotide
agggggaagttctatagtc

SEQ ID NO: 1651 - DNA, 25 bp, Artificial Sequence
  Description of Artificial Sequence: Synthetic oligonucleotide
  modified_base (17)..(17): a, c, t, g, unknown or other
aggctgtgatgctctcntgagccct

SEQ ID NO: 1652 - DNA, 19 bp, Artificial Sequence
  Description of Artificial Sequence: Synthetic oligonucleotide
agcccctctccggccctta

SEQ ID NO: 1653 - DNA, 17 bp, Artificial Sequence
  Description of Artificial Sequence: Synthetic oligonucleotide
actaccacctacctccc

SEQ ID NO: 1654 - DNA, 21 bp, Artificial Sequence
  Description of Artificial Sequence: Synthetic oligonucleotide
acgcccttcccccccttcttt

SEQ ID NO: 1655 - DNA, 18 bp, Artificial Sequence
  Description of Artificial Sequence: Synthetic oligonucleotide
accccactcctggtgcac

SEQ ID NO: 1656 - DNA, 18 bp, Artificial Sequence
  Description of Artificial Sequence: Synthetic oligonucleotide
accacctgatcccttccc

SEQ ID NO: 1657 - DNA, 18 bp, Artificial Sequence
  Description of Artificial Sequence: Synthetic oligonucleotide
acagctaagcacccacca

SEQ ID NO: 1658 - DNA, 17 bp, Artificial Sequence
  Description of Artificial Sequence: Synthetic oligonucleotide
acacatgtttaacggcc

SEQ ID NO: 1659 - DNA, 17 bp, Artificial Sequence
  Description of Artificial Sequence: Synthetic oligonucleotide
aattagggacctgtatg

SEQ ID NO: 1660 - DNA, 21 bp, Artificial Sequence
  Description of Artificial Sequence: Synthetic oligonucleotide
aatggcccatttgggcaaaca

SEQ ID NO: 1661 - DNA, 18 bp, Artificial Sequence
  Description of Artificial Sequence: Synthetic oligonucleotide
aaagcggctgtgcaaaca

SEQ ID NO: 1662 - DNA, 18 bp, Artificial Sequence
  Description of Artificial Sequence: Synthetic oligonucleotide
atcctgccgactacgcca

SEQ ID NO: 1663 - DNA, 22 bp, Artificial Sequence
  Description of Artificial Sequence: Synthetic oligonucleotide
tcgaatcccactcctgacacca

SEQ ID NO: 1664 - DNA, 18 bp, Artificial Sequence
  Description of Artificial Sequence: Synthetic oligonucleotide
atcccatcctcgtcgcca

SEQ ID NO: 1665 - DNA, 22 bp, Artificial Sequence
  Description of Artificial Sequence: Synthetic oligonucleotide
tcgattccccgacggggagcca

SEQ ID NO: 1666 - DNA, 18 bp, Artificial Sequence
  Description of Artificial Sequence: Synthetic oligonucleotide
atccgggtgccccctcca

SEQ ID NO: 1667 - DNA, 22 bp, Artificial Sequence
  Description of Artificial Sequence: Synthetic oligonucleotide
tcgactcctggctggctcgcca

SEQ ID NO: 1668 - DNA, 17 bp, Artificial Sequence
  Description of Artificial Sequence: Synthetic oligonucleotide
tcccgggcggcgcacca

SEQ ID NO: 1669 - DNA, 18 bp, Artificial Sequence
  Description of Artificial Sequence: Synthetic oligonucleotide
atcccaccagagtcgcca

SEQ ID NO: 1670 - DNA, 19 bp, Artificial Sequence
  Description of Artificial Sequence: Synthetic oligonucleotide
tccccggcatctccaccaa

SEQ ID NO: 1671 - DNA, 22 bp, Artificial Sequence
  Description of Artificial Sequence: Synthetic oligonucleotide
tcaaatcacgtcggggtcacca

SEQ ID NO: 1672 - DNA, 25 bp, Artificial Sequence
  Description of Artificial Sequence: Synthetic oligonucleotide
gcggtggatcactcggctcgtgcgt

SEQ ID NO: 1673 - DNA, 22 bp, Artificial Sequence
  Description of Artificial Sequence: Synthetic oligonucleotide
tcgatccccgtacgggccacca

SEQ ID NO: 1674 - DNA, 22 bp, Artificial Sequence
  Description of Artificial Sequence: Synthetic oligonucleotide
tcgagcctcacctggagcacca

SEQ ID NO: 1675 - DNA, 17 bp, Artificial Sequence
  Description of Artificial Sequence: Synthetic oligonucleotide
tccggctcgaaggacca

SEQ ID NO: 1676 - DNA, 14 bp, Artificial Sequence
  Description of Artificial Sequence: Synthetic oligonucleotide
ccgggtgttgtaga

SEQ ID NO: 1677 - DNA, 19 bp, Artificial Sequence
  Description of Artificial Sequence: Synthetic oligonucleotide
tgtagcgtggccgagcggt

SEQ ID NO: 1678 - DNA, 19 bp, Artificial Sequence
  Description of Artificial Sequence: Synthetic oligonucleotide
tggggcgacctcggagcag

SEQ ID NO: 1679 - DNA, 27 bp, Artificial Sequence
  Description of Artificial Sequence: Synthetic oligonucleotide
tggcgtcctaagccagggattgtgggt

SEQ ID NO: 1680 - DNA, 23 bp, Artificial Sequence
  Description of Artificial Sequence: Synthetic oligonucleotide
tggcaggggagataccatgattt

SEQ ID NO: 1681 - DNA, 19 bp, Artificial Sequence
  Description of Artificial Sequence: Synthetic oligonucleotide
tctgatcagggtgagcatc

SEQ ID NO: 1682 - DNA, 17 bp, Artificial Sequence
  Description of Artificial Sequence: Synthetic oligonucleotide
tcgtaggcaccatccat

SEQ ID NO: 1683 - DNA, 19 bp, Artificial Sequence
  Description of Artificial Sequence: Synthetic oligonucleotide
gggaaacggggcgcggctg

SEQ ID NO: 1684 - DNA, 24 bp, Artificial Sequence
  Description of Artificial Sequence: Synthetic oligonucleotide
ctactcctgctcgcatctgctata

SEQ ID NO: 1685 - DNA, 18 bp, Artificial Sequence
  Description of Artificial Sequence: Synthetic oligonucleotide
cgggtgggtttttaccgg

SEQ ID NO: 1686 - DNA, 18 bp, Artificial Sequence
  Description of Artificial Sequence: Synthetic oligonucleotide
cgaggaattcccagtaag

SEQ ID NO: 1687 - DNA, 19 bp, Artificial Sequence
  Description of Artificial Sequence: Synthetic oligonucleotide
cgaacgcacttgcggcccc

SEQ ID NO: 1688 - DNA, 19 bp, Artificial Sequence
  Description of Artificial Sequence: Synthetic oligonucleotide
ccccgcgcgggttcgaatc

SEQ ID NO: 1689 - DNA, 19 bp, Artificial Sequence
  Description of Artificial Sequence: Synthetic oligonucleotide
aggggtatgattcccgctt

SEQ ID NO: 1690 - DNA, 18 bp, Artificial Sequence
  Description of Artificial Sequence: Synthetic oligonucleotide
cggggccacgcgcgcgtc

SEQ ID NO: 1691 - DNA, 18 bp, Artificial Sequence
  Description of Artificial Sequence: Synthetic oligonucleotide
tggcgctgcgggatgaac

SEQ ID NO: 1692 - DNA, 27 bp, Artificial Sequence
  Description of Artificial Sequence: Synthetic oligonucleotide
ccccccactgctaaatttgactggctt

SEQ ID NO: 1693 - DNA, 19 bp, Artificial Sequence
  Description of Artificial Sequence: Synthetic oligonucleotide
taaaggttcgtttgtaaaa

SEQ ID NO: 1694 - DNA, 17 bp, Artificial Sequence
  Description of Artificial Sequence: Synthetic oligonucleotide
cggggccgagggagcga

SEQ ID NO: 1695 - DNA, 16 bp, Artificial Sequence
  Description of Artificial Sequence: Synthetic oligonucleotide
gggttaggcctctttt

SEQ ID NO: 1696 - DNA, 17 bp, Artificial Sequence
  Description of Artificial Sequence: Synthetic oligonucleotide
ctgcggaaggatcatta

SEQ ID NO: 1697 - DNA, 14 bp, Artificial Sequence
  Description of Artificial Sequence: Synthetic oligonucleotide
ccctacccccccgg

SEQ ID NO: 1698 - DNA, 16 bp, Artificial Sequence
  Description of Artificial Sequence: Synthetic oligonucleotide
cccgccgggtccgccc

SEQ ID NO: 1699 - DNA, 20 bp, Artificial Sequence
  Description of Artificial Sequence: Synthetic oligonucleotide
ccccgcgccctctctctctc

SEQ ID NO: 1700 - DNA, 17 bp, Artificial Sequence
  Description of Artificial Sequence: Synthetic oligonucleotide
caggcctccctggaatc

SEQ ID NO: 1701 - DNA, 19 bp, Artificial Sequence
  Description of Artificial Sequence: Synthetic oligonucleotide
agtcccacccggggtacca

SEQ ID NO: 1702 - DNA, 22 bp, Artificial Sequence
  Description of Artificial Sequence: Synthetic oligonucleotide
ttgacacgccccagtgccctgt

SEQ ID NO: 1703 - DNA, 19 bp, Artificial Sequence
  Description of Artificial Sequence: Synthetic oligonucleotide
tgggagcgggcgggcggtc

SEQ ID NO: 1704 - DNA, 18 bp, Artificial Sequence
  Description of Artificial Sequence: Synthetic oligonucleotide
tggcgtggagccgggcgt

SEQ ID NO: 1705 - DNA, 17 bp, Artificial Sequence
  Description of Artificial Sequence: Synthetic oligonucleotide
tggaggtccgtagcggt

SEQ ID NO: 1706 - DNA, 18 bp, Artificial Sequence
  Description of Artificial Sequence: Synthetic oligonucleotide
tgaagaaggtctcgaaca

SEQ ID NO: 1707 - DNA, 17 bp, Artificial Sequence
  Description of Artificial Sequence: Synthetic oligonucleotide
tctcgccggggcttcca

SEQ ID NO: 1708 - DNA, 18 bp, Artificial Sequence
  Description of Artificial Sequence: Synthetic oligonucleotide
tcgtagcaccatcaataa

SEQ ID NO: 1709 - DNA, 17 bp, Artificial Sequence
  Description of Artificial Sequence: Synthetic oligonucleotide
tccgggtcccccctcca

SEQ ID NO: 1710 - DNA, 20 bp, Artificial Sequence
  Description of Artificial Sequence: Synthetic oligonucleotide
tccggggctgcacgcgcgct

SEQ ID NO: 1711 - DNA, 15 bp, Artificial Sequence
  Description of Artificial Sequence: Synthetic oligonucleotide
tccggccgtgtcggt

SEQ ID NO: 1712 - DNA, 18 bp, Artificial Sequence
  Description of Artificial Sequence: Synthetic oligonucleotide
tccctgtcctccaggagt

SEQ ID NO: 1713 - DNA, 17 bp, Artificial Sequence
  Description of Artificial Sequence: Synthetic oligonucleotide
tcccctcctcgtcgcca

SEQ ID NO: 1714 - DNA, 19 bp, Artificial Sequence
  Description of Artificial Sequence: Synthetic oligonucleotide
tcccaggtagtctagtggt

SEQ ID NO: 1715 - DNA, 22 bp, Artificial Sequence
  Description of Artificial Sequence: Synthetic oligonucleotide
tattcatttatccccagcctat

SEQ ID NO: 1716 - DNA, 17 bp, Artificial Sequence
  Description of Artificial Sequence: Synthetic oligonucleotide
tagttgttataacccaa

SEQ ID NO: 1717 - DNA, 17 bp, Artificial Sequence
  Description of Artificial Sequence: Synthetic oligonucleotide
tagatcaccccctcccc

SEQ ID NO: 1718 - DNA, 17 bp, Artificial Sequence
  Description of Artificial Sequence: Synthetic oligonucleotide
taccggcacctggcgcc

SEQ ID NO: 1719 - DNA, 17 bp, Artificial Sequence
  Description of Artificial Sequence: Synthetic oligonucleotide
gtataggggcgaaagac

SEQ ID NO: 1720 - DNA, 19 bp, Artificial Sequence
  Description of Artificial Sequence: Synthetic oligonucleotide
gtagctggttccctccgaa

SEQ ID NO: 1721 - DNA, 17 bp, Artificial Sequence
  Description of Artificial Sequence: Synthetic oligonucleotide
ggtaagaagcccggctc

SEQ ID NO: 1722 - DNA, 19 bp, Artificial Sequence
  Description of Artificial Sequence: Synthetic oligonucleotide
gggggggtttaaaaaaaaa

SEQ ID NO: 1723 - DNA, 17 bp, Artificial Sequence
  Description of Artificial Sequence: Synthetic oligonucleotide
ggggcgcactaccggcc

SEQ ID NO: 1724 - DNA, 19 bp, Artificial Sequence
  Description of Artificial Sequence: Synthetic oligonucleotide
gggagaggctgtcgctgcg

SEQ ID NO: 1725 - DNA, 16 bp, Artificial Sequence
  Description of Artificial Sequence: Synthetic oligonucleotide
ggcgggtgaagcggcg

SEQ ID NO: 1726 - DNA, 17 bp, Artificial Sequence
  Description of Artificial Sequence: Synthetic oligonucleotide
gcggttccggcggcgtc

SEQ ID NO: 1727 - DNA, 24 bp, Artificial Sequence
  Description of Artificial Sequence: Synthetic oligonucleotide
gcggggcgcctaggcctggtttgt

SEQ ID NO: 1728 - DNA, 22 bp, Artificial Sequence
  Description of Artificial Sequence: Synthetic oligonucleotide
gcggcggtcggcgggcggcggg

SEQ ID NO: 1729 - DNA, 21 bp, Artificial Sequence
  Description of Artificial Sequence: Synthetic oligonucleotide
gagggggggggtgggggggga

SEQ ID NO: 1730 - DNA, 17 bp, Artificial Sequence
  Description of Artificial Sequence: Synthetic oligonucleotide
ctgtcggccaccatcat

SEQ ID NO: 1731 - DNA, 16 bp, Artificial Sequence
  Description of Artificial Sequence: Synthetic oligonucleotide
ctgcaactcgacccca

SEQ ID NO: 1732 - DNA, 19 bp, Artificial Sequence
  Description of Artificial Sequence: Synthetic oligonucleotide
ctcctctccccgcccgccg

SEQ ID NO: 1733 - DNA, 26 bp, Artificial Sequence
  Description of Artificial Sequence: Synthetic oligonucleotide
ctcaaagattaagccatgcatgtcta

SEQ ID NO: 1734 - DNA, 15 bp, Artificial Sequence
  Description of Artificial Sequence: Synthetic oligonucleotide
ctacgccgcgacgag

SEQ ID NO: 1735 - DNA, 22 bp, Artificial Sequence
  Description of Artificial Sequence: Synthetic oligonucleotide
cgggtgacggggaatcagggtt

SEQ ID NO: 1736 - DNA, 16 bp, Artificial Sequence
  Description of Artificial Sequence: Synthetic oligonucleotide
cgggcagcttccggga

SEQ ID NO: 1737 - DNA, 18 bp, Artificial Sequence
  Description of Artificial Sequence: Synthetic oligonucleotide
cgggaggcccgggtcctg

SEQ ID NO: 1738 - DNA, 17 bp, Artificial Sequence
  Description of Artificial Sequence: Synthetic oligonucleotide
cggccccgcatcctccc

SEQ ID NO: 1739 - DNA, 26 bp, Artificial Sequence
  Description of Artificial Sequence: Synthetic oligonucleotide
cgcgggtaaacggcgggagtaactat

SEQ ID NO: 1740 - DNA, 20 bp, Artificial Sequence
  Description of Artificial Sequence: Synthetic oligonucleotide
cgccccccgttcccccctcc

SEQ ID NO: 1741 - DNA, 15 bp, Artificial Sequence
  Description of Artificial Sequence: Synthetic oligonucleotide
cgagcggaaacacca

SEQ ID NO: 1742 - DNA, 15 bp, Artificial Sequence
  Description of Artificial Sequence: Synthetic oligonucleotide
cgaacccggcaccgc

SEQ ID NO: 1743 - DNA, 17 bp, Artificial Sequence
  Description of Artificial Sequence: Synthetic oligonucleotide
cctcgggccgatcgcac

SEQ ID NO: 1744 - DNA, 16 bp, Artificial Sequence
  Description of Artificial Sequence: Synthetic oligonucleotide
cctatatatcttacca

SEQ ID NO: 1745 - DNA, 17 bp, Artificial Sequence
  Description of Artificial Sequence: Synthetic oligonucleotide
ccgtggcggcgacgacc

SEQ ID NO: 1746 - DNA, 16 bp, Artificial Sequence
  Description of Artificial Sequence: Synthetic oligonucleotide
ccgggttccggcacca

SEQ ID NO: 1747 - DNA, 16 bp, Artificial Sequence
  Description of Artificial Sequence: Synthetic oligonucleotide
ccgcgaggggggcccg

SEQ ID NO: 1748 - DNA, 16 bp, Artificial Sequence
  Description of Artificial Sequence: Synthetic oligonucleotide
ccgcctcacgggacca

SEQ ID NO: 1749 - DNA, 20 bp, Artificial Sequence
  Description of Artificial Sequence: Synthetic oligonucleotide
ccgcccgtccccgccccttg

SEQ ID NO: 1750 - DNA, 18 bp, Artificial Sequence
  Description of Artificial Sequence: Synthetic oligonucleotide
cccggggccgcggttccg

SEQ ID NO: 1751 - DNA, 16 bp, Artificial Sequence
  Description of Artificial Sequence: Synthetic oligonucleotide
cccgagccgcctggat

SEQ ID NO: 1752 - DNA, 15 bp, Artificial Sequence
  Description of Artificial Sequence: Synthetic oligonucleotide
cccgacggccgaact

SEQ ID NO: 1753 - DNA, 19 bp, Artificial Sequence
  Description of Artificial Sequence: Synthetic oligonucleotide
ccccggggagcccggcggg

SEQ ID NO: 1754 - DNA, 19 bp, Artificial Sequence
  Description of Artificial Sequence: Synthetic oligonucleotide
ccccctcgcggccctcccc

SEQ ID NO: 1755 - DNA, 17 bp, Artificial Sequence
  Description of Artificial Sequence: Synthetic oligonucleotide
ccccccgtggcggcgac

SEQ ID NO: 1756 - DNA, 17 bp, Artificial Sequence
  Description of Artificial Sequence: Synthetic oligonucleotide
ccacccagggcacgcca

SEQ ID NO: 1757 - DNA, 16 bp, Artificial Sequence
  Description of Artificial Sequence: Synthetic oligonucleotide
cacgggtgacggggaa

SEQ ID NO: 1758 - DNA, 23 bp, Artificial Sequence
  Description of Artificial Sequence: Synthetic oligonucleotide
atggggaggaaaaaaaaaaaaaa

SEQ ID NO: 1759 - DNA, 18 bp, Artificial Sequence
  Description of Artificial Sequence: Synthetic oligonucleotide
atcccaccgctgccccca

SEQ ID NO: 1760 - DNA, 16 bp, Artificial Sequence
  Description of Artificial Sequence: Synthetic oligonucleotide
atcacgtcggtcacca

SEQ ID NO: 1761 - DNA, 23 bp, Artificial Sequence
  Description of Artificial Sequence: Synthetic oligonucleotide
acgggaaacctcacccggcccgg

SEQ ID NO: 1762 - DNA, 24 bp, Artificial Sequence
  Description of Artificial Sequence: Synthetic oligonucleotide
acagaggcttacgaccccttattt

SEQ ID NO: 1763 - DNA, 20 bp, Artificial Sequence
  Description of Artificial Sequence: Synthetic oligonucleotide
aaaaaggcataattaaactt

SEQ ID NO: 1764 - DNA, 18 bp, Artificial Sequence
  Description of Artificial Sequence: Synthetic oligonucleotide
tccccggcatctccacca

SEQ ID NO: 1765 - DNA, 18 bp, Artificial Sequence
  Description of Artificial Sequence: Synthetic oligonucleotide
tccccggcacctccacca

SEQ ID NO: 1766 - DNA, 18 bp, Artificial Sequence
  Description of Artificial Sequence: Synthetic oligonucleotide
atcccggacgagccccca

SEQ ID NO: 1767 - DNA, 18 bp, Artificial Sequence
  Description of Artificial Sequence: Synthetic oligonucleotide
atcccacttctgacacca

SEQ ID NO: 1768 - DNA, 18 bp, Artificial Sequence
  Description of Artificial Sequence: Synthetic oligonucleotide
atcccactcctgacacca

SEQ ID NO: 1769 - DNA, 18 bp, Artificial Sequence
  Description of Artificial Sequence: Synthetic oligonucleotide
tccccgtacgggccacca

SEQ ID NO: 1770 - DNA, 18 bp, Artificial Sequence
  Description of Artificial Sequence: Synthetic oligonucleotide
cggaagcgtgctgggccc

SEQ ID NO: 1771 - DNA, 18 bp, Artificial Sequence
  Description of Artificial Sequence: Synthetic oligonucleotide
tccccgacacctccacca

SEQ ID NO: 1772 - DNA, 18 bp, Artificial Sequence
  Description of Artificial Sequence: Synthetic oligonucleotide
gacgaggtggccgagtgg

SEQ ID NO: 1773 - DNA, 18 bp, Artificial Sequence
  Description of Artificial Sequence: Synthetic oligonucleotide
gtcccttcgtggtcgcca

SEQ ID NO: 1774 - DNA, 18 bp, Artificial Sequence
  Description of Artificial Sequence: Synthetic oligonucleotide
ctcctggctggctcgcca

SEQ ID NO: 1775 - DNA, 18 bp, Artificial Sequence
  Description of Artificial Sequence: Synthetic oligonucleotide
tcctcacacggggcacca

SEQ ID NO: 1776 - DNA, 18 bp, Artificial Sequence
  Description of Artificial Sequence: Synthetic oligonucleotide
gagggggaccaaaaaaaa

SEQ ID NO: 1777 - DNA, 18 bp, Artificial Sequence
  Description of Artificial Sequence: Synthetic oligonucleotide
tccccggcacttccacca

SEQ ID NO: 1778 - DNA, 18 bp, Artificial Sequence
  Description of Artificial Sequence: Synthetic oligonucleotide
agaacactacgagccaca

SEQ ID NO: 1779 - DNA, 18 bp, Artificial Sequence
  Description of Artificial Sequence: Synthetic oligonucleotide
accccacttctggtacca

SEQ ID NO: 1780 - DNA, 18 bp, Artificial Sequence
  Description of Artificial Sequence: Synthetic oligonucleotide
cgttcgcgctttcccctg

SEQ ID NO: 1781 - DNA, 18 bp, Artificial Sequence
  Description of Artificial Sequence: Synthetic oligonucleotide
ttccccgacggggagcca

SEQ ID NO: 1782 - DNA, 18 bp, Artificial Sequence
  Description of Artificial Sequence: Synthetic oligonucleotide
atgtggtggcttactttt

SEQ ID NO: 1783 - DNA, 19 bp, Artificial Sequence
  Description of Artificial Sequence: Synthetic oligonucleotide
agtcccatctgggtcgcca

SEQ ID NO: 1784 - DNA, 19 bp, Artificial Sequence
  Description of Artificial Sequence: Synthetic oligonucleotide
tggtgtggtctgttgtttt

SEQ ID NO: 1785 - DNA, 19 bp, Artificial Sequence
  Description of Artificial Sequence: Synthetic oligonucleotide
cgtccatgatgttccgcaa

SEQ ID NO: 1786 - DNA, 19 bp, Artificial Sequence
  Description of Artificial Sequence: Synthetic oligonucleotide
taggggtatgattctcgct

SEQ ID NO: 1787 - DNA, 19 bp, Artificial Sequence
  Description of Artificial Sequence: Synthetic oligonucleotide
ggcgtgattcatacctttt

SEQ ID NO: 1788 - DNA, 19 bp, Artificial Sequence
  Description of Artificial Sequence: Synthetic oligonucleotide
atccccagcatctccacca

SEQ ID NO: 1789 - DNA, 19 bp, Artificial Sequence
  Description of Artificial Sequence: Synthetic oligonucleotide
taccgagcctggtgatagc

SEQ ID NO: 1790 - DNA, 19 bp, Artificial Sequence
  Description of Artificial Sequence: Synthetic oligonucleotide
atccccagcacctccacca

SEQ ID NO: 1791 - DNA, 20 bp, Artificial Sequence
  Description of Artificial Sequence: Synthetic oligonucleotide
gccgggtactttcgtatttt

SEQ ID NO: 1792 - DNA, 20 bp, Artificial Sequence
  Description of Artificial Sequence: Synthetic oligonucleotide
ctgattgctcctgtctgatt

SEQ ID NO: 1793 - DNA, 20 bp, Artificial Sequence
  Description of Artificial Sequence: Synthetic oligonucleotide
ccacgaggaagagaggtagc

SEQ ID NO: 1794 - DNA, 20 bp, Artificial Sequence
  Description of Artificial Sequence: Synthetic oligonucleotide
accccactatgcttagccct

SEQ ID NO: 1795 - DNA, 20 bp, Artificial Sequence
  Description of Artificial Sequence: Synthetic oligonucleotide
aaaggacctggcggtgcttc

SEQ ID NO: 1796 - DNA, 21 bp, Artificial Sequence
  Description of Artificial Sequence: Synthetic oligonucleotide
tctagaggagcctgttctgta

SEQ ID NO: 1797 - DNA, 21 bp, Artificial Sequence
  Description of Artificial Sequence: Synthetic oligonucleotide
gtcaggatggccgagcggtct

SEQ ID NO: 1798 - DNA, 22 bp, Artificial Sequence
  Description of Artificial Sequence: Synthetic oligonucleotide
tcgattcccggccaatgcacca

SEQ ID NO: 1799 - DNA, 22 bp, Artificial Sequence
  Description of Artificial Sequence: Synthetic oligonucleotide
tcgattcccggcccatgcacca

SEQ ID NO: 1800 - DNA, 22 bp, Artificial Sequence
  Description of Artificial Sequence: Synthetic oligonucleotide
tcgggtgcgagaggtcccgggt

SEQ ID NO: 1801 - DNA, 22 bp, Artificial Sequence
  Description of Artificial Sequence: Synthetic oligonucleotide
tcgattcccggtcagggaacca

SEQ ID NO: 1802 - DNA, 22 bp, Artificial Sequence
  Description of Artificial Sequence: Synthetic oligonucleotide
gcattggtggttcagtggtaga

SEQ ID NO: 1803 - DNA, 22 bp, Artificial Sequence
  Description of Artificial Sequence: Synthetic oligonucleotide
ttctcactactgcacttgacta

SEQ ID NO: 1804 - DNA, 23 bp, Artificial Sequence
  Description of Artificial Sequence: Synthetic oligonucleotide
ggagagaacgcggtctgagtggt

SEQ ID NO: 1805 - DNA, 23 bp, Artificial Sequence
  Description of Artificial Sequence: Synthetic oligonucleotide
ggctggtccgatggtagtgggtt

SEQ ID NO: 1806 - DNA, 23 bp, Artificial Sequence
  Description of Artificial Sequence: Synthetic oligonucleotide
tgtgctccggagttacctcgttt

SEQ ID NO: 1807 - DNA, 23 bp, Artificial Sequence
  Description of Artificial Sequence: Synthetic oligonucleotide
ataggtttggtcctagcctttct

SEQ ID NO: 1808 - DNA, 23 bp, Artificial Sequence
  Description of Artificial Sequence: Synthetic oligonucleotide
gagccatgatgataccactgagc

SEQ ID NO: 1809 - DNA, 23 bp, Artificial Sequence
  Description of Artificial Sequence: Synthetic oligonucleotide
gcagcgccagcctcccgccctac

SEQ ID NO: 1810 - DNA, 24 bp, Artificial Sequence
  Description of Artificial Sequence: Synthetic oligonucleotide
cccccacaaccgcgcttgactagc

SEQ ID NO: 1811 - DNA, 24 bp, Artificial Sequence
  Description of Artificial Sequence: Synthetic oligonucleotide
ctcccactgcttcacttgactagc

SEQ ID NO: 1812 - DNA, 25 bp, Artificial Sequence
  Description of Artificial Sequence: Synthetic oligonucleotide
ccccccactgctaaatttgactgga

SEQ ID NO: 1813 - DNA, 26 bp, Artificial Sequence
  Description of Artificial Sequence: Synthetic oligonucleotide
gctaaggaagtcctgtgctcagtttt

SEQ ID NO: 1814 - DNA, 26 bp, Artificial Sequence
  Description of Artificial Sequence: Synthetic oligonucleotide
ggctggtccgagtgcagtggtgttta

SEQ ID NO: 1815 - DNA, 27 bp, Artificial Sequence
  Description of Artificial Sequence: Synthetic oligonucleotide
ccccccactgctaaatttgactggctt

SEQ ID NO: 1816 - DNA, 27 bp, Artificial Sequence
  Description of Artificial Sequence: Synthetic oligonucleotide
gcgggtgatgcgaactggagtctgagc

SEQ ID NO: 1817 - DNA, 27 bp, Artificial Sequence
  Description of Artificial Sequence: Synthetic oligonucleotide
agcagtgatgtcctgaaaattctgaag

SEQ ID NO: 1818 - DNA, 28 bp, Artificial Sequence
  Description of Artificial Sequence: Synthetic oligonucleotide
tccctggtggtctagtggttaggattcg

SEQ ID NO: 1819 - DNA, 28 bp, Artificial Sequence
  Description of Artificial Sequence: Synthetic oligonucleotide
aaccgagcgtccaagctctttccatttt

SEQ ID NO: 1820 - DNA, 28 bp, Artificial Sequence
  Description of Artificial Sequence: Synthetic oligonucleotide
tcctcgttagtatagtggtgagtatccc

SEQ ID NO: 1821 - DNA, 17 bp, Artificial Sequence
  Description of Artificial Sequence: Synthetic oligonucleotide
cccacccagggacgcca

SEQ ID NO: 1822 - DNA, 17 bp, Artificial Sequence
  Description of Artificial Sequence: Synthetic oligonucleotide
gcccgcatcctccacca

SEQ ID NO: 1823 - DNA, 17 bp, Artificial Sequence
  Description of Artificial Sequence: Synthetic oligonucleotide
ccctgctcgctgcgcca

SEQ ID NO: 1824 - DNA, 17 bp, Artificial Sequence
  Description of Artificial Sequence: Synthetic oligonucleotide
tcacgtcggggtcacca

SEQ ID NO: 1825 - DNA, 17 bp, Artificial Sequence
  Description of Artificial Sequence: Synthetic oligonucleotide
agggtgtgcgtgttttt

SEQ ID NO: 1826 - DNA, 17 bp, Artificial Sequence
  Description of Artificial Sequence: Synthetic oligonucleotide
tcctgccgcggtcgcca

SEQ ID NO: 1827 - DNA, 17 bp, Artificial Sequence
  Description of Artificial Sequence: Synthetic oligonucleotide
gagagcgctcggttttt

SEQ ID NO: 1828 - DNA, 17 bp, Artificial Sequence
  Description of Artificial Sequence: Synthetic oligonucleotide
ctgctgtgatgacattc

SEQ ID NO: 1829 - DNA, 17 bp, Artificial Sequence
  Description of Artificial Sequence: Synthetic oligonucleotide
cccgggtttcggcacca

SEQ ID NO: 1830 - DNA, 17 bp, Artificial Sequence
  Description of Artificial Sequence: Synthetic oligonucleotide
tccccgcacctccacca

SEQ ID NO: 1831 - DNA, 17 bp, Artificial Sequence
  Description of Artificial Sequence: Synthetic oligonucleotide
taacggccgcggtaccc

SEQ ID NO: 1832 - DNA, 17 bp, Artificial Sequence
  Description of Artificial Sequence: Synthetic oligonucleotide
aggggggtaaaaaaaaa

SEQ ID NO: 1833 - DNA, 17 bp, Artificial Sequence
  Description of Artificial Sequence: Synthetic oligonucleotide
tggttatcacgttcgcc

SEQ ID NO: 1834 - DNA, 17 bp, Artificial Sequence
  Description of Artificial Sequence: Synthetic oligonucleotide
tcaccccataaacacca

SEQ ID NO: 1835 - DNA, 17 bp, Artificial Sequence
  Description of Artificial Sequence: Synthetic oligonucleotide
agaaaggccgaatttta

SEQ ID NO: 1836 - DNA, 17 bp, Artificial Sequence
  Description of Artificial Sequence: Synthetic oligonucleotide
tgtattgtgagacattc

SEQ ID NO: 1837 - DNA, 17 bp, Artificial Sequence
  Description of Artificial Sequence: Synthetic oligonucleotide
tctcggtggaacctcca

SEQ ID NO: 1838 - DNA, 17 bp, Artificial Sequence
  Description of Artificial Sequence: Synthetic oligonucleotide
taagtgtttgtgggtta

SEQ ID NO: 1839 - DNA, 26 bp, Artificial Sequence
  Description of Artificial Sequence: Synthetic oligonucleotide
gctaaggaagtcctgtgctcagtttt

SEQ ID NO: 1840 - DNA, 22 bp, Artificial Sequence
  Description of Artificial Sequence: Synthetic oligonucleotide
tcgattcccggcccatgcacca

SEQ ID NO: 1841 - DNA, 27 bp, Artificial Sequence
  Description of Artificial Sequence: Synthetic oligonucleotide
ccccccactgctaaatttgactggctt

SEQ ID NO: 1842 - DNA, 18 bp, Artificial Sequence
  Description of Artificial Sequence: Synthetic oligonucleotide
atcccactcctgacacca

SEQ ID NO: 1843 - DNA, 19 bp, Artificial Sequence
  Description of Artificial Sequence: Synthetic oligonucleotide
agtcccatctgggtcgcca

SEQ ID NO: 1844 - DNA, 18 bp, Artificial Sequence
  Description of Artificial Sequence: Synthetic oligonucleotide
tccccggcacctccacca

SEQ ID NO: 1845 - DNA, 22 bp, Artificial Sequence
  Description of Artificial Sequence: Synthetic oligonucleotide
tcgattcccggccaatgcacca

SEQ ID NO: 1846 - DNA, 18 bp, Artificial Sequence
  Description of Artificial Sequence: Synthetic oligonucleotide
atcccacttctgacacca

SEQ ID NO: 1847 - DNA, 18 bp, Artificial Sequence
  Description of Artificial Sequence: Synthetic oligonucleotide
gacgaggtggccgagtgg

SEQ ID NO: 1848 - DNA, 22 bp, Artificial Sequence
  Description of Artificial Sequence: Synthetic oligonucleotide
gcattggtggttcagtggtaga

SEQ ID NO: 1849 - DNA, 27 bp, Artificial Sequence
  Description of Artificial Sequence: Synthetic oligonucleotide
gcgggtgatgcgaactggagtctgagc

SEQ ID NO: 1850 - DNA, 17 bp, Artificial Sequence
  Description of Artificial Sequence: Synthetic oligonucleotide
cccgggtttcggcacca

SEQ ID NO: 1851 - DNA, 20 bp, Artificial Sequence
  Description of Artificial Sequence: Synthetic oligonucleotide
gccgggtactttcgtatttt

SEQ ID NO: 1852 - DNA, 26 bp, Artificial Sequence
  Description of Artificial Sequence: Synthetic oligonucleotide
gctaaggaagtcctgtgctcagtttt

SEQ ID NO: 1853 - DNA, 20 bp, Artificial Sequence
  Description of Artificial Sequence: Synthetic oligonucleotide
tatcaatgatgcttctgaga

SEQ ID NO: 1854 - DNA, 22 bp, Artificial Sequence
  Description of Artificial Sequence: Synthetic oligonucleotide
tcgattcccggcccatgcacca

SEQ ID NO: 1855 - DNA, 17 bp, Artificial Sequence
  Description of Artificial Sequence: Synthetic oligonucleotide
agaaaggccgaatttta

SEQ ID NO: 1856 - DNA, 19 bp, Artificial Sequence
  Description of Artificial Sequence: Synthetic oligonucleotide
tggtgtggtctgttgtttt

SEQ ID NO: 1857 - DNA, 27 bp, Artificial Sequence
  Description of Artificial Sequence: Synthetic oligonucleotide
ccccccactgctaaatttgactggctt

SEQ ID NO: 1858 - DNA, 17 bp, Artificial Sequence
  Description of Artificial Sequence: Synthetic oligonucleotide
tccccgcacctccacca

SEQ ID NO: 1859 - DNA, 17 bp, Artificial Sequence
  Description of Artificial Sequence: Synthetic oligonucleotide
gagagcgctcggttttt

SEQ ID NO: 1860 - DNA, 18 bp, Artificial Sequence
  Description of Artificial Sequence: Synthetic oligonucleotide
atcccactcctgacacca

SEQ ID NO: 1861 - DNA, 19 bp, Artificial Sequence
  Description of Artificial Sequence: Synthetic oligonucleotide
ggcgtgattcatacctttt

SEQ ID NO: 1862 - DNA, 17 bp, Artificial Sequence
  Description of Artificial Sequence: Synthetic oligonucleotide
agggtgtgcgtgttttt

SEQ ID NO: 1863 - DNA, 28 bp, Artificial Sequence
  Description of Artificial Sequence: Synthetic oligonucleotide
aaccgagcgtccaagctctttccatttt

SEQ ID NO: 1864 - DNA, 18 bp, Artificial Sequence
  Description of Artificial Sequence: Synthetic oligonucleotide
tccccgacacctccacca

SEQ ID NO: 1865 - DNA, 17 bp, Artificial Sequence
  Description of Artificial Sequence: Synthetic oligonucleotide
gcccgcatcctccacca

SEQ ID NO: 1866 - DNA, 18 bp, Artificial Sequence
  Description of Artificial Sequence: Synthetic oligonucleotide
atgtggtggcttactttt

SEQ ID NO: 1867 - DNA, 18 bp, Artificial Sequence
  Description of Artificial Sequence: Synthetic oligonucleotide
tccccggcacttccacca

SEQ ID NO: 1868 - DNA, 17 bp, Artificial Sequence
  Description of Artificial Sequence: Synthetic oligonucleotide
tcaccccataaacacca

SEQ ID NO: 1869 - DNA, 18 bp, Artificial Sequence
  Description of Artificial Sequence: Synthetic oligonucleotide
ttccccgacggggagcca

SEQ ID NO: 1870 - DNA, 23 bp, Artificial Sequence
  Description of Artificial Sequence: Synthetic oligonucleotide
tgtgctccggagttacctcgttt

SEQ ID NO: 1871 - DNA, 17 bp, Artificial Sequence
  Description of Artificial Sequence: Synthetic oligonucleotide
tcacgtcggggtcacca

SEQ ID NO: 1872 - DNA, 19 bp, Artificial Sequence
  Description of Artificial Sequence: Synthetic oligonucleotide
agtcccatctgggtcgcca

SEQ ID NO: 1873 - DNA, 18 bp, Artificial Sequence
  Description of Artificial Sequence: Synthetic oligonucleotide
tccccgtacgggccacca

SEQ ID NO: 1874 - DNA, 18 bp, Artificial Sequence
  Description of Artificial Sequence: Synthetic oligonucleotide
gtcccttcgtggtcgcca

SEQ ID NO: 1875 - DNA, 21 bp, Artificial Sequence
  Description of Artificial Sequence: Synthetic oligonucleotide
gtcaggatggccgagcggtct

SEQ ID NO: 1876 - DNA, 17 bp, Artificial Sequence
  Description of Artificial Sequence: Synthetic oligonucleotide
aggggggtaaaaaaaaa

SEQ ID NO: 1877 - DNA, 17 bp, Artificial Sequence
  Description of Artificial Sequence: Synthetic oligonucleotide
cccacccagggacgcca

SEQ ID NO: 1878 - DNA, 18 bp, Artificial Sequence
  Description of Artificial Sequence: Synthetic oligonucleotide
tccccggcacctccacca

SEQ ID NO: 1879 - DNA, 18 bp, Artificial Sequence
  Description of Artificial Sequence: Synthetic oligonucleotide
gagggggaccaaaaaaaa

SEQ ID NO: 1880 - DNA, 19 bp, Artificial Sequence
  Description of Artificial Sequence: Synthetic oligonucleotide
taccgagcctggtgatagc

SEQ ID NO: 1881 - DNA, 22 bp, Artificial Sequence
  Description of Artificial Sequence: Synthetic oligonucleotide
tcgattcccggccaatgcacca

SEQ ID NO: 1882 - DNA, 23 bp, Artificial Sequence
  Description of Artificial Sequence: Synthetic oligonucleotide
gagccatgatgataccactgagc

SEQ ID NO: 1883 - DNA, 17 bp, Artificial Sequence
  Description of Artificial Sequence: Synthetic oligonucleotide
taacggccgcggtaccc

SEQ ID NO: 1884 - DNA, 23 bp, Artificial Sequence
  Description of Artificial Sequence: Synthetic oligonucleotide
gcagcgccagcctcccgccctac

SEQ ID NO: 1885 - DNA, 19 bp, Artificial Sequence
  Description of Artificial Sequence: Synthetic oligonucleotide
cgtccatgatgttccgcaa

SEQ ID NO: 1886 - DNA, 27 bp, Artificial Sequence
  Description of Artificial Sequence: Synthetic oligonucleotide
agcagtgatgtcctgaaaattctgaag

SEQ ID NO: 1887 - DNA, 20 bp, Artificial Sequence
  Description of Artificial Sequence: Synthetic oligonucleotide
aaaggacctggcggtgcttc

SEQ ID NO: 1888 - DNA, 18 bp, Artificial Sequence
  Description of Artificial Sequence: Synthetic oligonucleotide
atcccggacgagccccca

SEQ ID NO: 1889 - DNA, 18 bp, Artificial Sequence
  Description of Artificial Sequence: Synthetic oligonucleotide
tcctcacacggggcacca

SEQ ID NO: 1890 - DNA, 18 bp, Artificial Sequence
  Description of Artificial Sequence: Synthetic oligonucleotide
atcccacttctgacacca

SEQ ID NO: 1891 - DNA, 20 bp, Artificial Sequence
  Description of Artificial Sequence: Synthetic oligonucleotide
accccactatgcttagccct

SEQ ID NO: 1892 - DNA, 17 bp, Artificial Sequence
  Description of Artificial Sequence: Synthetic oligonucleotide
tgtattgtgagacattc

SEQ ID NO: 1893 - DNA, 17 bp, Artificial Sequence
  Description of Artificial Sequence: Synthetic oligonucleotide
tctcggtggaacctcca

SEQ ID NO: 1894 - DNA, 19 bp, Artificial Sequence
  Description of Artificial Sequence: Synthetic oligonucleotide
atccccagcacctccacca

SEQ ID NO: 1895 - DNA, 18 bp, Artificial Sequence
  Description of Artificial Sequence: Synthetic oligonucleotide
agaacactacgagccaca

SEQ ID NO: 1896 - DNA, 18 bp, Artificial Sequence
  Description of Artificial Sequence: Synthetic oligonucleotide
accccacttctggtacca

SEQ ID NO: 1897 - DNA, 18 bp, Artificial Sequence
  Description of Artificial Sequence: Synthetic oligonucleotide
cgttcgcgctttcccctg

SEQ ID NO: 1898 - DNA, 18 bp, Artificial Sequence
  Description of Artificial Sequence: Synthetic oligonucleotide
gacgaggtggccgagtgg

SEQ ID NO: 1899 - DNA, 18 bp, Artificial Sequence
  Description of Artificial Sequence: Synthetic oligonucleotide
tccccggcatctccacca

SEQ ID NO: 1900 - DNA, 20 bp, Artificial Sequence
  Description of Artificial Sequence: Synthetic oligonucleotide
ctgattgctcctatctgatt

SEQ ID NO: 1901 - DNA, 21 bp, Artificial Sequence
  Description of Artificial Sequence: Synthetic oligonucleotide
tctagaggagcctgttctgta

SEQ ID NO: 1902 - DNA, 22 bp, Artificial Sequence
  Description of Artificial Sequence: Synthetic oligonucleotide
tcgggtgcgagaggtcccgggt

SEQ ID NO: 1903 - DNA, 23 bp, Artificial Sequence
  Description of Artificial Sequence: Synthetic oligonucleotide
ataggtttggtcctagcctttct

SEQ ID NO: 1904 - DNA, 22 bp, Artificial Sequence
  Description of Artificial Sequence: Synthetic oligonucleotide
tcgattcccggtcagggaacca

SEQ ID NO: 1905 - DNA, 28 bp, Artificial Sequence
  Description of Artificial Sequence: Synthetic oligonucleotide
tcctcgttagtatagtggtgagtatccc

SEQ ID NO: 1906 - DNA, 28 bp, Artificial Sequence
  Description of Artificial Sequence: Synthetic oligonucleotide
tccctggtggtctagtggttaggattcg

SEQ ID NO: 1907 - DNA, 17 bp, Artificial Sequence
  Description of Artificial Sequence: Synthetic oligonucleotide
taagtgtttgtgggtta

SEQ ID NO: 1908 - DNA, 22 bp, Artificial Sequence
  Description of Artificial Sequence: Synthetic oligonucleotide
gcattggtggttcagtggtaga

SEQ ID NO: 1909 - DNA, 17 bp, Artificial Sequence
  Description of Artificial Sequence: Synthetic oligonucleotide
tggttatcacgttcgcc

SEQ ID NO: 1910 - DNA, 17 bp, Artificial Sequence
  Description of Artificial Sequence: Synthetic oligonucleotide
ccctgctcgctgcgcca

SEQ ID NO: 1911 - DNA, 22 bp, Artificial Sequence
  Description of Artificial Sequence: Synthetic oligonucleotide
ttctcactactgcacttgacta

SEQ ID NO: 1912 - DNA, 18 bp, Artificial Sequence
  Description of Artificial Sequence: Synthetic oligonucleotide
ctcctggctggctcgcca

SEQ ID NO: 1913 - DNA, 24 bp, Artificial Sequence
  Description of Artificial Sequence: Synthetic oligonucleotide
ctcccactgcttcacttgactagc

SEQ ID NO: 1914 - DNA, 17 bp, Artificial Sequence
  Description of Artificial Sequence: Synthetic oligonucleotide
ctgctgtgatgacattc

SEQ ID NO: 1915 - DNA, 17 bp, Artificial Sequence
  Description of Artificial Sequence: Synthetic oligonucleotide
tcctgccgcggtcgcca

SEQ ID NO: 1916 - DNA, 27 bp, Artificial Sequence
  Description of Artificial Sequence: Synthetic oligonucleotide
gcgggtgatgcgaactggagtctgagc

SEQ ID NO: 1917 - DNA, 24 bp, Artificial Sequence
  Description of Artificial Sequence: Synthetic oligonucleotide
cccccacaaccgcgcttgactagc

SEQ ID NO: 1918 - DNA, 19 bp, Artificial Sequence
  Description of Artificial Sequence: Synthetic oligonucleotide
taggggtatgattctcgct

SEQ ID NO: 1919 - DNA, 26 bp, Artificial Sequence
  Description of Artificial Sequence: Synthetic oligonucleotide
ggctggtccgagtgcagtggtgttta

SEQ ID NO: 1920 - DNA, 23 bp, Artificial Sequence
  Description of Artificial Sequence: Synthetic oligonucleotide
ggctggtccgatggtagtgggtt

SEQ ID NO: 1921 - DNA, 20 bp, Artificial Sequence
  Description of Artificial Sequence: Synthetic oligonucleotide
ccacgaggaagagaggtagc

SEQ ID NO: 1922 - DNA, 18 bp, Artificial Sequence
  Description of Artificial Sequence: Synthetic oligonucleotide
cggaagcgtgctgggccc

SEQ ID NO: 1923 - DNA, 23 bp, Artificial Sequence
  Description of Artificial Sequence: Synthetic oligonucleotide
ggagagaacgcggtctgagtggt

SEQ ID NO: 1924 - DNA, 19 bp, Artificial Sequence
  Description of Artificial Sequence: Synthetic oligonucleotide
atccccagcatctccacca

SEQ ID NO: 1925 - DNA, 25 bp, Artificial Sequence
  Description of Artificial Sequence: Synthetic oligonucleotide
ccccccactgctaaatttgactgga

SEQ ID NO: 1926 - DNA, 26 bp, Artificial Sequence
  Description of Artificial Sequence: Synthetic primer
aaaactgagcacaggacttccttagc

SEQ ID NO: 1927 - DNA, 22 bp, Artificial Sequence
  Description of Artificial Sequence: Synthetic primer
tggtgcatgggccgggaatcga

SEQ ID NO: 1928 - DNA, 27 bp, Artificial Sequence
  Description of Artificial Sequence: Synthetic primer
aagccagtcaaatttagcagtgggggg

SEQ ID NO: 1929 - DNA, 18 bp, Artificial Sequence
  Description of Artificial Sequence: Synthetic probe
tggtgtcaggagtgggat

SEQ ID NO: 1930 - DNA, 19 bp, Artificial Sequence
  Description of Artificial Sequence: Synthetic probe
tggcgacccagatgggact

SEQ ID NO: 1931 - DNA, 18 bp, Artificial Sequence
  Description of Artificial Sequence: Synthetic probe
tggtggaggtgccgggga

SEQ ID NO: 1932 - DNA, 22 bp, Artificial Sequence
  Description of Artificial Sequence: Synthetic probe
tggtgcattggccgggaatcga

SEQ ID NO: 1933 - DNA, 18 bp, Artificial Sequence
  Description of Artificial Sequence: Synthetic probe
tggtgtcagaagtgggat

SEQ ID NO: 1934 - DNA, 20 bp, Artificial Sequence
  Description of Artificial Sequence: Synthetic probe
aaccactcggccacctcgtc

SEQ ID NO: 1935 - DNA, 22 bp, Artificial Sequence
  Description of Artificial Sequence: Synthetic probe
tctaccactgaaccaccaatgc

SEQ ID NO: 1936 - DNA, 27 bp, Artificial Sequence
  Description of Artificial Sequence: Synthetic probe
gctcagactccagttcgcatcacccgc

SEQ ID NO: 1937 - DNA, 36 bp, Artificial Sequence
  Description of Artificial Sequence: Synthetic primer
tgtcaggcaaccgtattcaccgtgagtggttggtgc

SEQ ID NO: 1938 - DNA, 38 bp, Artificial Sequence
  Description of Artificial Sequence: Synthetic primer
tgtcaggcaaccgtattcaccgtgagtggtaaaatacg

SEQ ID NO: 1939 - DNA, 40 bp, Artificial Sequence
  Description of Artificial Sequence: Synthetic primer
tgtcaggcaaccgtattcaccgtgagtggtaaaactgagc

SEQ ID NO: 1940 - DNA, 36 bp, Artificial Sequence
  Description of Artificial Sequence: Synthetic primer
tgtcaggcaaccgtattcaccgtgagtggttctcag

SEQ ID NO: 1941 - DNA, 36 bp, Artificial Sequence
  Description of Artificial Sequence: Synthetic primer
tgtcaggcaaccgtatcaccgtgagtggtttggtgc

SEQ ID NO: 1942 - DNA, 40 bp, Artificial Sequence
  Description of Artificial Sequence: Synthetic primer
tgtcaggcaaccgtattcaccgtgagtggttaaaattcgg

SEQ ID NO: 1943 - DNA, 40 bp, Artificial Sequence
  Description of Artificial Sequence: Synthetic primer
tgtcaggcaaccgtattcaccgtgagtggtaaaacaacag

SEQ ID NO: 1944 - DNA, 36 bp, Artificial Sequence
  Description of Artificial Sequence: Synthetic primer
tgtcaggcaaccgtattcaccgtgagtggtaagcca

SEQ ID NO: 1945 - DNA, 36 bp, Artificial Sequence
  Description of Artificial Sequence: Synthetic primer
tgtcaggcaaccgtattcaccgtgagtggttggtgg

SEQ ID NO: 1946 - DNA, 38 bp, Artificial Sequence
  Description of Artificial Sequence: Synthetic primer
tgtcaggcaaccgtattcaccgtgagtggtaaaaaccg

SEQ ID NO: 1947 - DNA, 36 bp, Artificial Sequence
  Description of Artificial Sequence: Synthetic primer
tgtcaggcaaccgtattcaccgtgagtggttggtgt

SEQ ID NO: 1948 - DNA, 40 bp, Artificial Sequence
  Description of Artificial Sequence: Synthetic primer
tgtcaggcaaccgtattcaccgtgagtggtaaaaggtatg

SEQ ID NO: 1949 - DNA, 40 bp, Artificial Sequence
  Description of Artificial Sequence: Synthetic primer
tgtcaggcaaccgtattcaccgtgagtggtaaaaacacgc

SEQ ID NO: 1950 - DNA, 36 bp, Artificial Sequence
  Description of Artificial Sequence: Synthetic primer
tgtcaggcaaccgtattcaccgtgagtggtaaaatg

SEQ ID NO: 1951 - DNA, 36 bp, Artificial Sequence; identical to SEQ ID NO: 1945
  Description of Artificial Sequence: Synthetic primer

SEQ ID NO: 1952 - DNA, 36 bp, Artificial Sequence; identical to SEQ ID NO: 1945
  Description of Artificial Sequence: Synthetic primer

SEQ ID NO: 1953 - DNA, 40 bp, Artificial Sequence
  Description of Artificial Sequence: Synthetic primer
tgtcaggcaaccgtattcaccgtgagtggtaaaagtaagc

SEQ ID NO: 1954 - DNA, 36 bp, Artificial Sequence; identical to SEQ ID NO: 1945
  Description of Artificial Sequence: Synthetic primer

SEQ ID NO: 1955 - DNA, 36 bp, Artificial Sequence; identical to SEQ ID NO: 1947
  Description of Artificial Sequence: Synthetic primer

SEQ ID NO: 1956 - DNA, 36 bp, Artificial Sequence
  Description of Artificial Sequence: Synthetic primer
tgtcaggcaaccgtattcaccgtgagtggttggctc

SEQ ID NO: 1957 - DNA, 38 bp, Artificial Sequence
  Description of Artificial Sequence: Synthetic primer
tgtcaggcaaccgtattcaccgtgagtggtaaacgagg

SEQ ID NO: 1958 - DNA, 36 bp, Artificial Sequence
  Description of Artificial Sequence: Synthetic primer
tgtcaggcaaccgtattcaccgtgagtggttggtga

SEQ ID NO: 1959 - DNA, 36 bp, Artificial Sequence
  Description of Artificial Sequence: Synthetic primer
tgtcaggcaaccgtattcaccgtgagtggttggcga

SEQ ID NO: 1960 - DNA, 36 bp, Artificial Sequence; identical to SEQ ID NO: 1945
  Description of Artificial Sequence: Synthetic primer

SEQ ID NO: 1961 - DNA, 36 bp, Artificial Sequence; identical to SEQ ID NO: 1959
  Description of Artificial Sequence: Synthetic primer

SEQ ID NO: 1962 - DNA, 36 bp, Artificial Sequence
  Description of Artificial Sequence: Synthetic primer
tgtcaggcaaccgtattcaccgtgagtggtagaccg

SEQ ID NO: 1963 - DNA, 36 bp, Artificial Sequence
  Description of Artificial Sequence: Synthetic primer
tgtcaggcaaccgtattcaccgtgagtggttttttt

SEQ ID NO: 1964 - DNA, 36 bp, Artificial Sequence
  Description of Artificial Sequence: Synthetic primer
tgtcaggcaaccgtattcaccgtgagtggttggcgt

SEQ ID NO: 1965 - DNA, 36 bp, Artificial Sequence; identical to SEQ ID NO: 1945
  Description of Artificial Sequence: Synthetic primer

SEQ ID NO: 1966 - DNA, 40 bp, Artificial Sequence
  Description of Artificial Sequence: Synthetic primer
tgtcaggcaaccgtattcaccgtgagtggtttttttttgg

SEQ ID NO: 1967 - DNA, 36 bp, Artificial Sequence
  Description of Artificial Sequence: Synthetic primer
tgtcaggcaaccgtattcaccgtgagtggtgctatc

SEQ ID NO: 1968 - DNA, 40 bp, Artificial Sequence
  Description of Artificial Sequence: Synthetic primer
tgtcaggcaaccgtattcaccgtgagtggttggtgcattg

SEQ ID NO: 1969 - DNA, 36 bp, Artificial Sequence
  Description of Artificial Sequence: Synthetic primer
tgtcaggcaaccgtattcaccgtgagtggtgctcag

SEQ ID NO: 1970 - DNA, 36 bp, Artificial Sequence
  Description of Artificial Sequence: Synthetic primer
tgtcaggcaaccgtattcaccgtgagtggtgggtac

SEQ ID NO: 1971 - DNA, 36 bp, Artificial Sequence
  Description of Artificial Sequence: Synthetic primer
tgtcaggcaaccgtattcaccgtgagtggtgtaggg

SEQ ID NO: 1972 - DNA, 36 bp, Artificial Sequence
  Description of Artificial Sequence: Synthetic primer
tgtcaggcaaccgtattcaccgtgagtggtttgcgg

SEQ ID NO: 1973 - DNA, 41 bp, Artificial Sequence
  Description of Artificial Sequence: Synthetic primer
tgtcaggcaaccgtattcaccgtgagtggtcttcagaattt

SEQ ID NO: 1974 - DNA, 36 bp, Artificial Sequence
  Description of Artificial Sequence: Synthetic primer
tgtcaggcaaccgtattcaccgtgagtggtgaagca

SEQ ID NO: 1975 - DNA, 36 bp, Artificial Sequence
  Description of Artificial Sequence: Synthetic primer
tgtcaggcaaccgtattcaccgtgagtggttggggg

SEQ ID NO: 1976 - DNA, 36 bp, Artificial Sequence; identical to SEQ ID NO: 1937
  Description of Artificial Sequence: Synthetic primer

SEQ ID NO: 1977 - DNA, 36 bp, Artificial Sequence; identical to SEQ ID NO: 1947
  Description of Artificial Sequence: Synthetic primer

SEQ ID NO: 1978 - DNA, 36 bp, Artificial Sequence
  Description of Artificial Sequence: Synthetic primer
tgtcaggcaaccgtattcaccgtgagtggtagggct

SEQ ID NO: 1979 - DNA, 36 bp, Artificial Sequence
  Description of Artificial Sequence: Synthetic primer
tgtcaggcaaccgtattcaccgtgagtggtgaatgt

SEQ ID NO: 1980 - DNA, 36 bp, Artificial Sequence
  Description of Artificial Sequence: Synthetic primer
tgtcaggcaaccgtattcaccgtgagtggttggagg

SEQ ID NO: 1981 - DNA, 36 bp, Artificial Sequence; identical to SEQ ID NO: 1945
  Description of Artificial Sequence: Synthetic primer

SEQ ID NO: 1982 - DNA, 36 bp, Artificial Sequence
  Description of Artificial Sequence: Synthetic primer
tgtcaggcaaccgtattcaccgtgagtggttgtggc

SEQ ID NO: 1983 - DNA, 38 bp, Artificial Sequence
  Description of Artificial Sequence: Synthetic primer
tgtcaggcaaccgtattcaccgtgagtggttggtacca

SEQ ID NO: 1984 - DNA, 40 bp, Artificial Sequence
  Description of Artificial Sequence: Synthetic primer
tgtcaggcaaccgtattcaccgtgagtggtcaggggaaag

SEQ ID NO: 1985 - DNA, 36 bp, Artificial Sequence
  Description of Artificial Sequence: Synthetic primer
tgtcaggcaaccgtattcaccgtgagtggtccactc

SEQ ID NO: 1986 - DNA, 36 bp, Artificial Sequence; identical to SEQ ID NO: 1945
  Description of Artificial Sequence: Synthetic primer

SEQ ID NO: 1987 - DNA, 36 bp, Artificial Sequence
  Description of Artificial Sequence: Synthetic primer
tgtcaggcaaccgtattcaccgtgagtggtaatcag

SEQ ID NO: 1988 - DNA, 36 bp, Artificial Sequence
  Description of Artificial Sequence: Synthetic primer
tgtcaggcaaccgtattcaccgtgagtggttacaga

SEQ ID NO: 1989 - DNA, 40 bp, Artificial Sequence
  Description of Artificial Sequence: Synthetic primer
tgtcaggcaaccgtattcaccgtgagtggtacccgggacc

SEQ ID NO: 1990 - DNA, 36 bp, Artificial Sequence
  Description of Artificial Sequence: Synthetic primer
tgtcaggcaaccgtattcaccgtgagtggtagaaag

SEQ ID NO: 1991 - DNA, 36 bp, Artificial Sequence
  Description of Artificial Sequence: Synthetic primer
tgtcaggcaaccgtattcaccgtgagtggttggttc

SEQ ID NO: 1992 - DNA, 36 bp, Artificial Sequence
  Description of Artificial Sequence: Synthetic primer
tgtcaggcaaccgtattcaccgtgagtggtgggata

SEQ ID NO: 1993 - DNA, 36 bp, Artificial Sequence
  Description of Artificial Sequence: Synthetic primer
tgtcaggcaaccgtattcaccgtgagtggtcgaatc

SEQ ID NO: 1994 - DNA, 39 bp, Artificial Sequence
  Description of Artificial Sequence: Synthetic primer
tgtcaggcaaccgtattcaccgtgagtggttaacccaca

SEQ ID NO: 1995 - DNA, 36 bp, Artificial Sequence
  Description of Artificial Sequence: Synthetic primer
tgtcaggcaaccgtattcaccgtgagtggttctacc

SEQ ID NO: 1996 - DNA, 39 bp, Artificial Sequence
  Description of Artificial Sequence: Synthetic primer
tgtcaggcaaccgtattcaccgtgagtggtggcgaacgt

SEQ ID NO: 1997 - DNA, 36 bp, Artificial Sequence
  Description of Artificial Sequence: Synthetic primer
tgtcaggcaaccgtattcaccgtgagtggttggcgc

SEQ ID NO: 1998 - DNA, 36 bp, Artificial Sequence
  Description of Artificial Sequence: Synthetic primer
tgtcaggcaaccgtattcaccgtgagtggttagtca

SEQ ID NO: 1999 - DNA, 36 bp, Artificial Sequence; identical to SEQ ID NO: 1959
  Description of Artificial Sequence: Synthetic primer

SEQ ID NO: 2000 - DNA, 36 bp, Artificial Sequence
  Description of Artificial Sequence: Synthetic primer
tgtcaggcaaccgtattcaccgtgagtggtgctagt

SEQ ID NO: 2001 - DNA, 36 bp, Artificial Sequence; identical to SEQ ID NO: 1979
  Description of Artificial Sequence: Synthetic primer

SEQ ID NO: 2002 - DNA, 36 bp, Artificial Sequence; identical to SEQ ID NO: 1959
  Description of Artificial Sequence: Synthetic primer

SEQ ID NO: 2003 - DNA, 36 bp, Artificial Sequence; identical to SEQ ID NO: 1969
  Description of Artificial Sequence: Synthetic primer

SEQ ID NO: 2004 - DNA, 36 bp, Artificial Sequence; identical to SEQ ID NO: 2000
  Description of Artificial Sequence: Synthetic primer

SEQ ID NO: 2005 - DNA, 36 bp, Artificial Sequence
  Description of Artificial Sequence: Synthetic primer
tgtcaggcaaccgtattcaccgtgagtggtagcgag

SEQ ID NO: 2006 - DNA, 40 bp, Artificial Sequence
  Description of Artificial Sequence: Synthetic primer
tgtcaggcaaccgtattcaccgtgagtggttaaacaccac

SEQ ID NO: 2007 - DNA, 36 bp, Artificial Sequence
  Description of Artificial Sequence: Synthetic primer
tgtcaggcaaccgtattcaccgtgagtggtaaccca

SEQ ID NO: 2008 - DNA, 39 bp, Artificial Sequence
  Description of Artificial Sequence: Synthetic primer
tgtcaggcaaccgtattcaccgtgagtggtgctacctct

SEQ ID NO: 2009 - DNA, 36 bp, Artificial Sequence
  Description of Artificial Sequence: Synthetic primer
tgtcaggcaaccgtattcaccgtgagtggtgggccc

SEQ ID NO: 2010 - DNA, 36 bp, Artificial Sequence
  Description of Artificial Sequence: Synthetic primer
tgtcaggcaaccgtattcaccgtgagtggtaccact

SEQ ID NO: 2011 - DNA, 36 bp, Artificial Sequence; identical to SEQ ID NO: 1945
  Description of Artificial Sequence: Synthetic primer

SEQ ID NO: 2012 - DNA, 36 bp, Artificial Sequence
  Description of Artificial Sequence: Synthetic primer
tgtcaggcaaccgtattcaccgtgagtggttccagt

SEQ ID NO: 2013 - DNA, 42 bp, Artificial Sequence
  Description of Artificial Sequence: Synthetic primer
cgtcagatgtccgagtagagggggaacggcgcccgggtttcg

SEQ ID NO: 2014 - DNA, 43 bp, Artificial Sequence
  Description of Artificial Sequence: Synthetic primer
cgtcagatgtccgagtagagggggaacggcggccgggtacttt

SEQ ID NO: 2015 - DNA, 47 bp, Artificial Sequence
  Description of Artificial Sequence: Synthetic primer
cgtcagatgtccgagtagagggggaacggcggctaaggaagtcctgt

SEQ ID NO: 2016 - DNA, 45 bp, Artificial Sequence
  Description of Artificial Sequence: Synthetic primer
cgtcagatgtccgagtagagggggaacggcgtatcaatgatgctt

SEQ ID NO: 2017 - DNA, 47 bp, Artificial Sequence
  Description of Artificial Sequence: Synthetic primer
cgtcagatgtccgagtagagggggaacggcgtcgattcccggcccat

SEQ ID NO: 2018 - DNA, 41 bp, Artificial Sequence
  Description of Artificial Sequence: Synthetic primer
cgtcagatgtccgagtagagggggaacggcgagaaaggccg

SEQ ID NO: 2019 - DNA, 43 bp, Artificial Sequence
  Description of Artificial Sequence: Synthetic primer
cgtcagatgtccgagtagagggggaacggcgtggtgtggtctg

SEQ ID NO: 2020 - DNA, 50 bp, Artificial Sequence
  Description of Artificial Sequence: Synthetic primer
cgtcagatgtccgagtagagggggaacggcgccccccactgctaaatttg

SEQ ID NO: 2021 - DNA, 42 bp, Artificial Sequence
  Description of Artificial Sequence: Synthetic primer
cgtcagatgtccgagtagagggggaacggcgtccccgcacct

SEQ ID NO: 2022 - DNA, 40 bp, Artificial Sequence
  Description of Artificial Sequence: Synthetic primer
cgtcagatgtccgagtagagggggaacggcggagagcgct

SEQ ID NO: 2023 - DNA, 43 bp, Artificial Sequence
  Description of Artificial Sequence: Synthetic primer
cgtcagatgtccgagtagagggggaacggcgatcccactcctg

SEQ ID NO: 2024 - DNA, 43 bp, Artificial Sequence
  Description of Artificial Sequence: Synthetic primer
cgtcagatgtccgagtagagggggaacggcgggcgtgattcat

SEQ ID NO: 2025 - DNA, 42 bp, Artificial Sequence
  Description of Artificial Sequence: Synthetic primer
cgtcagatgtccgagtagagggggaacggcgagggtgtgcgt

SEQ ID NO: 2026 - DNA, 50 bp, Artificial Sequence
  Description of Artificial Sequence: Synthetic primer
cgtcagatgtccgagtagagggggaacggcgaaccgagcgtccaagctct

SEQ ID NO: 2027 - DNA, 43 bp, Artificial Sequence
  Description of Artificial Sequence: Synthetic primer
cgtcagatgtccgagtagagggggaacggcgtccccgacacct

SEQ ID NO: 2028 - DNA, 42 bp, Artificial Sequence
  Description of Artificial Sequence: Synthetic primer
cgtcagatgtccgagtagagggggaacggcggcccgcatcct

SEQ ID NO: 2029 - DNA, 43 bp, Artificial Sequence
  Description of Artificial Sequence: Synthetic primer
cgtcagatgtccgagtagagggggaacggcgatgtggtggctt

SEQ ID NO: 2030 - DNA, 43 bp, Artificial Sequence
  Description of Artificial Sequence: Synthetic primer
cgtcagatgtccgagtagagggggaacggcgtccccggcactt

SEQ ID NO: 2031 - DNA, 42 bp, Artificial Sequence
  Description of Artificial Sequence: Synthetic primer
cgtcagatgtccgagtagagggggaacggcgtcaccccataa

SEQ ID NO: 2032 - DNA, 43 bp, Artificial Sequence
  Description of Artificial Sequence: Synthetic primer
cgtcagatgtccgagtagagggggaacggcgttccccgacggg

SEQ ID NO: 2033 - DNA, 46 bp, Artificial Sequence
  Description of Artificial Sequence: Synthetic primer
cgtcagatgtccgagtagagggggaacggcgtgtgctccggagtta

SEQ ID NO: 2034 - DNA, 42 bp, Artificial Sequence
  Description of Artificial Sequence: Synthetic primer
cgtcagatgtccgagtagagggggaacggcgtcacgtcgggg

SEQ ID NO: 2035 - DNA, 44 bp, Artificial Sequence
  Description of Artificial Sequence: Synthetic primer
cgtcagatgtccgagtagagggggaacggcgagtcccatctggg

SEQ ID NO: 2036 - DNA, 43 bp, Artificial Sequence
  Description of Artificial Sequence: Synthetic primer
cgtcagatgtccgagtagagggggaacggcgtccccgtacggg

SEQ ID NO: 2037 - DNA, 43 bp, Artificial Sequence
  Description of Artificial Sequence: Synthetic primer
cgtcagatgtccgagtagagggggaacggcggtcccttcgtgg

SEQ ID NO: 2038 - DNA, 46 bp, Artificial Sequence
  Description of Artificial Sequence: Synthetic primer
cgtcagatgtccgagtagagggggaacggcggtcaggatggccgag

SEQ ID NO: 2039 - DNA, 42 bp, Artificial Sequence
  Description of Artificial Sequence: Synthetic primer
cgtcagatgtccgagtagagggggaacggcgaggggggtaaa

SEQ ID NO: 2040 - DNA, 42 bp, Artificial Sequence
  Description of Artificial Sequence: Synthetic primer
cgtcagatgtccgagtagagggggaacggcgcccacccaggg

SEQ ID NO: 2041 - DNA, 43 bp, Artificial Sequence
  Description of Artificial Sequence: Synthetic primer
cgtcagatgtccgagtagagggggaacggcgtccccggcacct

SEQ ID NO: 2042 - DNA, 39 bp, Artificial Sequence
  Description of Artificial Sequence: Synthetic primer
cgtcagatgtccgagtagagggggaacggcggaggggga

SEQ ID NO: 2043 - DNA, 44 bp, Artificial Sequence
  Description of Artificial Sequence: Synthetic primer
cgtcagatgtccgagtagagggggaacggcgtaccgagcctggt

SEQ ID NO: 2044 - DNA, 43 bp, Artificial Sequence
  Description of Artificial Sequence: Synthetic primer
cgtcagatgtccgagtagagggggaacggcgtcgattcccggc

SEQ ID NO: 2045 - DNA, 48 bp, Artificial Sequence
  Description of Artificial Sequence: Synthetic primer
cgtcagatgtccgagtagagggggaacggcggagccatgatgatacca

SEQ ID NO: 2046 - DNA, 42 bp, Artificial Sequence
  Description of Artificial Sequence: Synthetic primer
cgtcagatgtccgagtagagggggaacggcgtaacggccgcg

SEQ ID NO: 2047 - DNA, 48 bp, Artificial Sequence
  Description of Artificial Sequence: Synthetic primer
cgtcagatgtccgagtagagggggaacggcggcagcgccagcctcccg

SEQ ID NO: 2048 - DNA, 44 bp, Artificial Sequence
  Description of Artificial Sequence: Synthetic primer
cgtcagatgtccgagtagagggggaacggcgcgtccatgatgtt

SEQ ID NO: 2049 - DNA, 47 bp, Artificial Sequence
  Description of Artificial Sequence: Synthetic primer
cgtcagatgtccgagtagagggggaacggcgagcagtgatgtcctga

SEQ ID NO: 2050 - DNA, 45 bp, Artificial Sequence
  Description of Artificial Sequence: Synthetic primer
cgtcagatgtccgagtagagggggaacggcgaaaggacctggcgg

SEQ ID NO: 2051 - DNA, 43 bp, Artificial Sequence
  Description of Artificial Sequence: Synthetic primer
cgtcagatgtccgagtagagggggaacggcgatcccggacgag

SEQ ID NO: 2052 - DNA, 43 bp, Artificial Sequence
  Description of Artificial Sequence: Synthetic primer
cgtcagatgtccgagtagagggggaacggcgtcctcacacggg

SEQ ID NO: 2053 - DNA, 43 bp, Artificial Sequence
  Description of Artificial Sequence: Synthetic primer
cgtcagatgtccgagtagagggggaacggcgatcccacttctg

SEQ ID NO: 2054 - DNA, 45 bp, Artificial Sequence
  Description of Artificial Sequence: Synthetic primer
cgtcagatgtccgagtagagggggaacggcgaccccactatgctt

SEQ ID NO: 2055 - DNA, 42 bp, Artificial Sequence
  Description of Artificial Sequence: Synthetic primer
cgtcagatgtccgagtagagggggaacggcgtgtattgtgag

SEQ ID NO: 2056 - DNA, 42 bp, Artificial Sequence
  Description of Artificial Sequence: Synthetic primer
cgtcagatgtccgagtagagggggaacggcgtctcggtggaa

SEQ ID NO: 2057 - DNA, 44 bp, Artificial Sequence
  Description of Artificial Sequence: Synthetic primer
cgtcagatgtccgagtagagggggaacggcgatccccagcacct

SEQ ID NO: 2058 - DNA, 43 bp, Artificial Sequence
  Description of Artificial Sequence: Synthetic primer
cgtcagatgtccgagtagagggggaacggcgagaacactacga

SEQ ID NO: 2059 - DNA, 41 bp, Artificial Sequence
  Description of Artificial Sequence: Synthetic primer
cgtcagatgtccgagtagagggggaacggcgaccccacttc

SEQ ID NO: 2060 - DNA, 39 bp, Artificial Sequence
  Description of Artificial Sequence: Synthetic primer
cgtcagatgtccgagtagagggggaacggcgcgttcgcg

SEQ ID NO: 2061 - DNA, 43 bp, Artificial Sequence
  Description of Artificial Sequence: Synthetic primer
cgtcagatgtccgagtagagggggaacggcggacgaggtggcc

SEQ ID NO: 2062 - DNA, 43 bp, Artificial Sequence
  Description of Artificial Sequence: Synthetic primer
cgtcagatgtccgagtagagggggaacggcgtccccggcatct

SEQ ID NO: 2063 - DNA, 45 bp, Artificial Sequence
  Description of Artificial Sequence: Synthetic primer
cgtcagatgtccgagtagagggggaacggcgctgattgctcctat

SEQ ID NO: 2064 - DNA, 46 bp, Artificial Sequence
  Description of Artificial Sequence: Synthetic primer
cgtcagatgtccgagtagagggggaacggcgtctagaggagcctgt

SEQ ID NO: 2065 - DNA, 43 bp, Artificial Sequence
  Description of Artificial Sequence: Synthetic primer
cgtcagatgtccgagtagagggggaacggcgtcgggtgcgaga

SEQ ID NO: 2066 - DNA, 48 bp, Artificial Sequence
  Description of Artificial Sequence: Synthetic primer
cgtcagatgtccgagtagagggggaacggcgataggtttggtcctagc

SEQ ID NO: 2067 - DNA, 47 bp, Artificial Sequence
  Description of Artificial Sequence: Synthetic primer
cgtcagatgtccgagtagagggggaacggcgtcgattcccggtcagg

SEQ ID NO: 2068 - DNA, 50 bp, Artificial Sequence
  Description of Artificial Sequence: Synthetic primer
cgtcagatgtccgagtagagggggaacggcgtcctcgttagtatagtggt

SEQ ID NO: 2069 - DNA, 50 bp, Artificial Sequence
  Description of Artificial Sequence: Synthetic primer
cgtcagatgtccgagtagagggggaacggcgtccctggtggtctagtggt

SEQ ID NO: 2070 - DNA, 39 bp, Artificial Sequence
  Description of Artificial Sequence: Synthetic primer
cgtcagatgtccgagtagagggggaacggcgtaagtgtt

SEQ ID NO: 2071 - DNA, 47 bp, Artificial Sequence
  Description of Artificial Sequence: Synthetic primer
cgtcagatgtccgagtagagggggaacggcggcattggtggttcagt

SEQ ID NO: 2072 - DNA, 39 bp, Artificial Sequence
  Description of Artificial Sequence: Synthetic primer
cgtcagatgtccgagtagagggggaacggcgtggttatc

SEQ ID NO: 2073 - DNA, 42 bp, Artificial Sequence
  Description of Artificial Sequence: Synthetic primer
cgtcagatgtccgagtagagggggaacggcgccctgctcgct

SEQ ID NO: 2074 - DNA, 47 bp, Artificial Sequence
  Description of Artificial Sequence: Synthetic primer
cgtcagatgtccgagtagagggggaacggcgttctcactactgcact

SEQ ID NO: 2075 - DNA, 43 bp, Artificial Sequence
  Description of Artificial Sequence: Synthetic primer
cgtcagatgtccgagtagagggggaacggcgctcctggctggc

SEQ ID NO: 2076 - DNA, 49 bp, Artificial Sequence
  Description of Artificial Sequence: Synthetic primer
cgtcagatgtccgagtagagggggaacggcgctcccactgcttcacttg

SEQ ID NO: 2077 - DNA, 42 bp, Artificial Sequence
  Description of Artificial Sequence: Synthetic primer
cgtcagatgtccgagtagagggggaacggcgctgctgtgatg

SEQ ID NO: 2078 - DNA, 42 bp, Artificial Sequence
  Description of Artificial Sequence: Synthetic primer
cgtcagatgtccgagtagagggggaacggcgtcctgccgcgg

SEQ ID NO: 2079 - DNA, 50 bp, Artificial Sequence
  Description of Artificial Sequence: Synthetic primer
cgtcagatgtccgagtagagggggaacggcggcgggtgatgcgaactgga

SEQ ID NO: 2080 - DNA, 49 bp, Artificial Sequence
  Description of Artificial Sequence: Synthetic primer
cgtcagatgtccgagtagagggggaacggcgcccccacaaccgcgcttg

SEQ ID NO: 2081 - DNA, 44 bp, Artificial Sequence
  Description of Artificial Sequence: Synthetic primer
cgtcagatgtccgagtagagggggaacggcgtaggggtatgatt

SEQ ID NO: 2082 - DNA, 50 bp, Artificial Sequence
  Description of Artificial Sequence: Synthetic primer
cgtcagatgtccgagtagagggggaacggcgggctggtccgagtgcagtg

SEQ ID NO: 2083 - DNA, 48 bp, Artificial Sequence
  Description of Artificial Sequence: Synthetic primer
cgtcagatgtccgagtagagggggaacggcgggctggtccgatggtag

SEQ ID NO: 2084 - DNA, 42 bp, Artificial Sequence
  Description of Artificial Sequence: Synthetic primer
cgtcagatgtccgagtagagggggaacggcgccacgaggaag

SEQ ID NO: 2085 - DNA, 43 bp, Artificial Sequence
  Description of Artificial Sequence: Synthetic primer
cgtcagatgtccgagtagagggggaacggcgcggaagcgtgct

SEQ ID NO: 2086 - DNA, 48 bp, Artificial Sequence
  Description of Artificial Sequence: Synthetic primer
cgtcagatgtccgagtagagggggaacggcgggagagaacgcggtctg

SEQ ID NO: 2087 - DNA, 44 bp, Artificial Sequence
  Description of Artificial Sequence: Synthetic primer
cgtcagatgtccgagtagagggggaacggcgatccccagcatct

SEQ ID NO: 2088 - DNA, 50 bp, Artificial Sequence; identical to SEQ ID NO: 2020
  Description of Artificial Sequence: Synthetic primer

SEQ ID NO: 2089 - DNA, 21 bp, Artificial Sequence
  Description of Artificial Sequence: Synthetic primer
tgtcaggcaaccgtattcacc

SEQ ID NO: 2090 - DNA, 21 bp, Artificial Sequence
  Description of Artificial Sequence: Synthetic primer
cgtcagatgtccgagtagagg

SEQ ID NO: 2091 - DNA, 19 bp, Artificial Sequence
  Description of Artificial Sequence: Synthetic primer
gcccgatctcgtctgatct

SEQ ID NO: 2092 - DNA, 20 bp, Artificial Sequence
  Description of Artificial Sequence: Synthetic primer
agcctacagcacccggtatt

SEQ ID NO: 2093 - DNA, 22 bp, Artificial Sequence
  Description of Artificial Sequence: Synthetic oligonucleotide
tgaggtagtaggttgtatagtt

SEQ ID NO: 2094 - DNA, 22 bp, Artificial Sequence
  Description of Artificial Sequence: Synthetic oligonucleotide
tgaggtagtaggttgtatagtt

SEQ ID NO: 2095 - DNA, 22 bp, Artificial Sequence
  Description of Artificial Sequence: Synthetic oligonucleotide
tgaggtagtaggttgtgtggtt

SEQ ID NO: 2096 - DNA, 22 bp, Artificial Sequence
  Description of Artificial Sequence: Synthetic oligonucleotide
agaggtagtaggttgcatagtt

SEQ ID NO: 2097 - DNA, 22 bp, Artificial Sequence
  Description of Artificial Sequence: Synthetic oligonucleotide
tgaggtaggaggttgtatagtt

SEQ ID NO: 2098 - DNA, 22 bp, Artificial Sequence
  Description of Artificial Sequence: Synthetic oligonucleotide
tgaggtagtagattgtatagtt

SEQ ID NO: 2099 - DNA, 22 bp, Artificial Sequence
  Description of Artificial Sequence: Synthetic oligonucleotide
tgaggtagtagtttgtacagtt

SEQ ID NO: 2100 - DNA, 22 bp, Artificial Sequence
  Description of Artificial Sequence: Synthetic oligonucleotide
tgaggtagtagtttgtgctgtt

SEQ ID NO: 2101 - DNA, 22 bp, Artificial Sequence
  Description of Artificial Sequence: Synthetic oligonucleotide
tacagtactgtgataactgaag

SEQ ID NO: 2102 - DNA, 22 bp, Artificial Sequence
  Description of Artificial Sequence: Synthetic oligonucleotide
tacagtactgtgataactgaag

SEQ ID NO: 2103 - DNA, 23 bp, Artificial Sequence
  Description of Artificial Sequence: Synthetic oligonucleotide
agcagcattgtacagggctatga

SEQ ID NO: 2104 - DNA, 20 bp, Artificial Sequence
  Description of Artificial Sequence: Synthetic oligonucleotide
ccgcactgtgggtacttgct

SEQ ID NO: 2105 - DNA, 21 bp, Artificial Sequence
  Description of Artificial Sequence: Synthetic oligonucleotide
taaagtgctgacagtgcagat

SEQ ID NO: 2106 - DNA, 24 bp, Artificial Sequence
  Description of Artificial Sequence: Synthetic oligonucleotide
tccctgagaccctttaacctgtga

SEQ ID NO: 2107 - DNA, 22 bp, Artificial Sequence
  Description of Artificial Sequence: Synthetic oligonucleotide
tccctgagaccctaacttgtga

SEQ ID NO: 2108 - DNA, 18 bp, Artificial Sequence
  Description of Artificial Sequence: Synthetic oligonucleotide
gtccctgttcgggcgcca

SEQ ID NO: 2109 - DNA, 18 bp, Artificial Sequence
  Description of Artificial Sequence: Synthetic oligonucleotide
gtccctgttcgggcgcca

SEQ ID NO: 2110 - DNA, 17 bp, Artificial Sequence
  Description of Artificial Sequence: Synthetic oligonucleotide
gtgggggagaggctgta

SEQ ID NO: 2111 - DNA, 17 bp, Artificial Sequence
  Description of Artificial Sequence: Synthetic oligonucleotide
tcccaccgctgccacca

SEQ ID NO: 2112 - DNA, 17 bp, Artificial Sequence
  Description of Artificial Sequence: Synthetic oligonucleotide
tcccaccgctgccacca

SEQ ID NO: 2113 - DNA, 17 bp, Artificial Sequence
  Description of Artificial Sequence: Synthetic oligonucleotide
tcccaccgctgccacca

SEQ ID NO: 2114 - DNA, 17 bp, Artificial Sequence
  Description of Artificial Sequence: Synthetic oligonucleotide
tcccaccgctgccacca

SEQ ID NO: 2115 - DNA, 17 bp, Artificial Sequence
  Description of Artificial Sequence: Synthetic oligonucleotide
tcccaccgctgccacca

SEQ ID NO: 2116 - DNA, 17 bp, Artificial Sequence
  Description of Artificial Sequence: Synthetic oligonucleotide
tcccaccgctgccacca

SEQ ID NO: 2117 - DNA, 17 bp, Artificial Sequence
  Description of Artificial Sequence: Synthetic oligonucleotide
tcccaccgctgccacca

SEQ ID NO: 2118 - DNA, 21 bp, Artificial Sequence
  Description of Artificial Sequence: Synthetic oligonucleotide
tcacagtgaaccggtctcttt

SEQ ID NO: 2119 - DNA, 23 bp, Artificial Sequence
  Description of Artificial Sequence: Synthetic oligonucleotide
gcatgggtggttcagtggtagaa

SEQ ID NO: 2120 - DNA, 23 bp, Artificial Sequence
  Description of Artificial Sequence: Synthetic oligonucleotide
gcatgggtggttcagtggtagaa

SEQ ID NO: 2121 - DNA, 23 bp, Artificial Sequence
  Description of Artificial Sequence: Synthetic oligonucleotide
gcatgggtggttcagtggtagaa

SEQ ID NO: 2122 - DNA, 23 bp, Artificial Sequence
  Description of Artificial Sequence: Synthetic oligonucleotide
gcatgggtggttcagtggtagaa

SEQ ID NO: 2123 - DNA, 23 bp, Artificial Sequence
  Description of Artificial Sequence: Synthetic oligonucleotide
gcatgggtggttcagtggtagaa

SEQ ID NO: 2124 - DNA, 22 bp, Artificial Sequence
  Description of Artificial Sequence: Synthetic oligonucleotide
cagtgcaatgatgaaagggcat

SEQ ID NO: 2125 - DNA, 24 bp, Artificial Sequence
  Description of Artificial Sequence: Synthetic oligonucleotide
agctggtgttgtgaatcaggccgt

SEQ ID NO: 2126 - DNA, 22 bp, Artificial Sequence
  Description of Artificial Sequence: Synthetic oligonucleotide
taccacagggtagaaccacgga

SEQ ID NO: 2127 - DNA, 21 bp, Artificial Sequence
  Description of Artificial Sequence: Synthetic oligonucleotide
cagtggttttaccctatggta

SEQ ID NO: 2128 - DNA, 23 bp, Artificial Sequence
  Description of Artificial Sequence: Synthetic oligonucleotide
tgtagtgtttcctactttatgga

SEQ ID NO: 2129 - DNA, 22 bp, Artificial Sequence
  Description of Artificial Sequence: Synthetic oligonucleotide
tgagaactgaattccatgggtt

SEQ ID NO: 2130 - DNA, 24 bp, Artificial Sequence
  Description of Artificial Sequence: Synthetic oligonucleotide
tgagaactgaattccataggctgt

SEQ ID NO: 2131 - DNA, 21 bp, Artificial Sequence
  Description of Artificial Sequence: Synthetic oligonucleotide
tctcccaacccttgtaccagt

SEQ ID NO: 2132 - DNA, 21 bp, Artificial Sequence
  Description of Artificial Sequence: Synthetic oligonucleotide
ctagactgaagctccttgagg

SEQ ID NO: 2133 - DNA, 21 bp, Artificial Sequence
  Description of Artificial Sequence: Synthetic oligonucleotide
ctagactgaagctccttgagg

SEQ ID NO: 2134 - DNA, 22 bp, Artificial Sequence
  Description of Artificial Sequence: Synthetic oligonucleotide
tcgaggagctcacagtctagta

SEQ ID NO: 2135 - DNA, 22 bp, Artificial Sequence
  Description of Artificial Sequence: Synthetic oligonucleotide
tcgaggagctcacagtctagta

SEQ ID NO: 2136 - DNA, 23 bp, Artificial Sequence
  Description of Artificial Sequence: Synthetic oligonucleotide
ttaatgctaatcgtgataggggt

SEQ ID NO: 2137 - DNA, 21 bp, Artificial Sequence
  Description of Artificial Sequence: Synthetic oligonucleotide
tagcagcacataatggtttgt

SEQ ID NO: 2138 - DNA, 21 bp, Artificial Sequence
  Description of Artificial Sequence: Synthetic oligonucleotide
tagcagcacataatggtttgt

SEQ ID NO: 2139 - DNA, 21 bp, Artificial Sequence
  Description of Artificial Sequence: Synthetic oligonucleotide
cgaatcattatttgctgctct

SEQ ID NO: 2140 - DNA, 22 bp, Artificial Sequence
  Description of Artificial Sequence: Synthetic oligonucleotide
tagcagcacatcatggtttaca

SEQ ID NO: 2141 - DNA, 22 bp, Artificial Sequence
  Description of Artificial Sequence: Synthetic oligonucleotide
tagcagcacgtaaatattggcg

SEQ ID NO: 2142 - DNA, 22 bp, Artificial Sequence
  Description of Artificial Sequence: Synthetic oligonucleotide
tagcagcacgtaaatattggcg

SEQ ID NO: 2143 - DNA, 22 bp, Artificial Sequence
  Description of Artificial Sequence: Synthetic oligonucleotide
actgcagtgaaggcacttgtag

SEQ ID NO: 2144 - DNA, 23 bp, Artificial Sequence
  Description of Artificial Sequence: Synthetic oligonucleotide
caaagtgcttacagtgcaggtag

SEQ ID NO: 2145 - DNA, 20 bp, Artificial Sequence
  Description of Artificial Sequence: Synthetic oligonucleotide
accatcgaccgttgattgta

SEQ ID NO: 2146 - DNA, 24 bp, Artificial Sequence
  Description of Artificial Sequence: Synthetic oligonucleotide
aacattcaacgctgtcggtgagtt

SEQ ID NO: 2147 - DNA, 24 bp, Artificial Sequence
  Description of Artificial Sequence: Synthetic oligonucleotide
aacattcaacgctgtcggtgagtt

SEQ ID NO: 2148 - DNA, 22 bp, Artificial Sequence
  Description of Artificial Sequence: Synthetic oligonucleotide
actgccctaagtgctccttctg

SEQ ID NO: 2149 - DNA, 22 bp, Artificial Sequence
  Description of Artificial Sequence: Synthetic oligonucleotide
taaggtgcatctagtgcagata

SEQ ID NO: 2150 - DNA, 23 bp, Artificial Sequence
  Description of Artificial Sequence: Synthetic oligonucleotide
caacggaatcccaaaagcagctg

SEQ ID NO: 2151 - DNA, 20 bp, Artificial Sequence
  Description of Artificial Sequence: Synthetic oligonucleotide
ctgacctatgaattgacagc

SEQ ID NO: 2152 - DNA, 22 bp, Artificial Sequence
  Description of Artificial Sequence: Synthetic oligonucleotide
aactggccctcaaagtcccgct

SEQ ID NO: 2153 - DNA, 22 bp, Artificial Sequence
  Description of Artificial Sequence: Synthetic oligonucleotide
tagcagcacagaaatattggca

SEQ ID NO: 2154 - DNA, 21 bp, Artificial Sequence
  Description of Artificial Sequence: Synthetic oligonucleotide
ttcaccaccttctccacccag

SEQ ID NO: 2155 - DNA, 23 bp, Artificial Sequence
  Description of Artificial Sequence: Synthetic oligonucleotide
cccagtgttcagactacctgttc

SEQ ID NO: 2156 - DNA, 23 bp, Artificial Sequence
  Description of Artificial Sequence: Synthetic oligonucleotide
cccagtgttcagactacctgttc

SEQ ID NO: 2157 - DNA, 21 bp, Artificial Sequence
  Description of Artificial Sequence: Synthetic oligonucleotide
acagtagtctgcacattggtt

SEQ ID NO: 2158 - DNA, 21 bp, Artificial Sequence
  Description of Artificial Sequence: Synthetic oligonucleotide
acagtagtctgcacattggtt

SEQ ID NO: 2159 - DNA, 21 bp, Artificial Sequence
  Description of Artificial Sequence: Synthetic oligonucleotide
acagtagtctgcacattggtt

SEQ ID NO: 2160 - DNA, 23 bp, Artificial Sequence
  Description of Artificial Sequence: Synthetic oligonucleotide
tgtgcaaatctatgcaaaactga

SEQ ID NO: 2161 - DNA, 23 bp, Artificial Sequence
  Description of Artificial Sequence: Synthetic oligonucleotide
tgtgcaaatccatgcaaaactga

SEQ ID NO: 2162 - DNA, 23 bp, Artificial Sequence
  Description of Artificial Sequence: Synthetic oligonucleotide
tgtgcaaatccatgcaaaactga

SEQ ID NO: 2163 - DNA, 23 bp, Artificial Sequence
  Description of Artificial Sequence: Synthetic oligonucleotide
taaagtgcttatagtgcaggtag

SEQ ID NO: 2164 - DNA, 23 bp, Artificial Sequence
  Description of Artificial Sequence: Synthetic oligonucleotide
caaagtgcttatagtgcaggtag

SEQ ID NO: 2165 - DNA, 22 bp, Artificial Sequence
  Description of Artificial Sequence: Synthetic oligonucleotide
tagcttatcagactgatgttga

SEQ ID NO: 2166 - DNA, 21 bp, Artificial Sequence
  Description of Artificial Sequence: Synthetic oligonucleotide
agctacattgtctgctgggtt

SEQ ID NO: 2167 - DNA, 23 bp, Artificial Sequence
  Description of Artificial Sequence: Synthetic oligonucleotide
agctacatctggctactgggtct

SEQ ID NO: 2168 - DNA, 22 bp, Artificial Sequence
  Description of Artificial Sequence: Synthetic oligonucleotide
tgtcagtttgtcaaatacccca

SEQ ID NO: 2169 - DNA, 22 bp, Artificial Sequence
  Description of Artificial Sequence: Synthetic oligonucleotide
atcacattgccagggatttcca

SEQ ID NO: 2170 - DNA, 22 bp, Artificial Sequence
  Description of Artificial Sequence: Synthetic oligonucleotide
atcacattgccagggattacca

SEQ ID NO: 2171 - DNA, 22 bp, Artificial Sequence
  Description of Artificial Sequence: Synthetic oligonucleotide
cattgcacttgtctcggtctga

SEQ ID NO: 2172 - DNA, 22 bp, Artificial Sequence
  Description of Artificial Sequence: Synthetic oligonucleotide
ttcaagtaatccaggataggct

SEQ ID NO: 2173 - DNA, 22 bp, Artificial Sequence
  Description of Artificial Sequence: Synthetic oligonucleotide
ttcaagtaatccaggataggct

SEQ ID NO: 2174 - DNA, 22 bp, Artificial Sequence
  Description of Artificial Sequence: Synthetic oligonucleotide
ttcaagtaattcaggataggtt

SEQ ID NO: 2175 - DNA, 20 bp, Artificial Sequence
  Description of Artificial Sequence: Synthetic oligonucleotide
ttcacagtggctaagttctg

SEQ ID NO: 2176 - DNA, 22 bp, Artificial Sequence
  Description of Artificial Sequence: Synthetic oligonucleotide
cactagattgtgagctcctgga

SEQ ID NO: 2177 - DNA, 22 bp, Artificial Sequence
  Description of Artificial Sequence: Synthetic oligonucleotide
aaggagctcacagtctattgag

SEQ ID NO: 2178 - DNA, 22 bp, Artificial Sequence
  Description of Artificial Sequence: Synthetic oligonucleotide
tagcaccatctgaaatcggtta

SEQ ID NO: 2179 - DNA, 23 bp, Artificial Sequence
  Description of Artificial Sequence: Synthetic oligonucleotide
tagcaccatttgaaatcagtgtt

SEQ ID NO: 2180 - DNA, 21 bp, Artificial Sequence
  Description of Artificial Sequence: Synthetic oligonucleotide
tgaccgatttctcctggtgtt

SEQ ID NO: 2181 - DNA, 22 bp, Artificial Sequence
  Description of Artificial Sequence: Synthetic oligonucleotide
tagcaccatttgaaatcggtta

SEQ ID NO: 2182 - DNA, 20 bp, Artificial Sequence
  Description of Artificial Sequence: Synthetic oligonucleotide
tgtaaacatcctcgactgga

SEQ ID NO: 2183 - DNA, 22 bp, Artificial Sequence
  Description of Artificial Sequence: Synthetic oligonucleotide
tgtaaacatcctacactcagct

SEQ ID NO: 2184 - DNA, 23 bp, Artificial Sequence
  Description of Artificial Sequence: Synthetic oligonucleotide
tgtaaacatcctacactctcagc

SEQ ID NO: 2185 - DNA, 22 bp, Artificial Sequence
  Description of Artificial Sequence: Synthetic oligonucleotide
tgtaaacatccccgactggaag

SEQ ID NO: 2186 - DNA, 24 bp, Artificial Sequence
  Description of Artificial Sequence: Synthetic oligonucleotide
tgtaaacatccttgactggaagct

SEQ ID NO: 2187 - DNA, 16 bp, Artificial Sequence
  Description of Artificial Sequence: Synthetic oligonucleotide
tgggttgagagggcga

SEQ ID NO: 2188 - DNA, 18 bp, Artificial Sequence
  Description of Artificial Sequence: Synthetic oligonucleotide
ctggccctctctgccctt

SEQ ID NO: 2189 - DNA, 21 bp, Artificial Sequence
  Description of Artificial Sequence: Synthetic oligonucleotide
gcccctgggcctatcctagaa

SEQ ID NO: 2190 - DNA, 20 bp, Artificial Sequence
  Description of Artificial Sequence: Synthetic oligonucleotide
tccctgtcctccaggagctc

SEQ ID NO: 2191 - DNA, 20 bp, Artificial Sequence
  Description of Artificial Sequence: Synthetic oligonucleotide
tccctgtcctccaggagctc

SEQ ID NO: 2192 - DNA, 24 bp, Artificial Sequence
  Description of Artificial Sequence: Synthetic oligonucleotide
tctcacacagaaatcgcacccgtc

SEQ ID NO: 2193 - DNA, 20 bp, Artificial Sequence
  Description of Artificial Sequence: Synthetic oligonucleotide
ggggtgctatctgtgattga

SEQ ID NO: 2194 - DNA, 23 bp, Artificial Sequence
  Description of Artificial Sequence: Synthetic oligonucleotide
tggcagtgtcttagctggttgtt

SEQ ID NO: 2195 - DNA, 22 bp, Artificial Sequence
  Description of Artificial Sequence: Synthetic oligonucleotide
tcccccaggtgtgattctgatt

SEQ ID NO: 2196 - DNA, 22 bp, Artificial Sequence
  Description of Artificial Sequence: Synthetic oligonucleotide
taatgcccctaaaaatccttat

SEQ ID NO: 2197 - DNA, 22 bp, Artificial Sequence
  Description of Artificial Sequence: Synthetic oligonucleotide
taatgcccctaaaaatccttat

SEQ ID NO: 2198 - DNA, 21 bp, Artificial Sequence
  Description of Artificial Sequence: Synthetic oligonucleotide
ctcctgactccaggtcctgtg

SEQ ID NO: 2199 - DNA, 22 bp, Artificial Sequence
  Description of Artificial Sequence: Synthetic oligonucleotide
agctcggtctgaggcccctcag

SEQ ID NO: 2200 - DNA, 22 bp, Artificial Sequence
  Description of Artificial Sequence: Synthetic oligonucleotide
tgaggggcagagagcgagactt

SEQ ID NO: 2201 - DNA, 22 bp, Artificial Sequence
  Description of Artificial Sequence: Synthetic oligonucleotide
tcctgtactgagctgccccgag

SEQ ID NO: 2202 - DNA, 21 bp, Artificial Sequence
  Description of Artificial Sequence: Synthetic oligonucleotide
cagcagcacactgtggtttgt

SEQ ID NO: 2203 - DNA, 18 bp, Artificial Sequence
  Description of Artificial Sequence: Synthetic oligonucleotide
cgtcaacacttgctggtt

SEQ ID NO: 2204 - DNA, 21 bp, Artificial Sequence
  Description of Artificial Sequence: Synthetic oligonucleotide
cacgctcatgcacacacccac

SEQ ID NO: 2205 - DNA, 20 bp, Artificial Sequence
  Description of Artificial Sequence: Synthetic oligonucleotide
agggggaaagttctatagtc

SEQ ID NO: 2206 - DNA, 20 bp, Artificial Sequence
  Description of Artificial Sequence: Synthetic oligonucleotide
agggggaaagttctatagtc

SEQ ID NO: 2207 - DNA, 21 bp, Artificial Sequence
  Description of Artificial Sequence: Synthetic oligonucleotide
tgggtttacgttgggagaact

SEQ ID NO: 2208 - DNA, 21 bp, Artificial Sequence
  Description of Artificial Sequence: Synthetic oligonucleotide
caacaaatcacagtctgccat

SEQ ID NO: 2209 - DNA, 23 bp, Artificial Sequence
  Description of Artificial Sequence: Synthetic oligonucleotide
tggaagactagtgattttgttgt

SEQ ID NO: 2210 - DNA, 23 bp, Artificial Sequence
  Description of Artificial Sequence: Synthetic oligonucleotide
tggaagactagtgattttgttgt

SEQ ID NO: 2211 - DNA, 23 bp, Artificial Sequence
  Description of Artificial Sequence: Synthetic oligonucleotide
tggaagactagtgattttgttgt

SEQ ID NO: 2212 - DNA, 23 bp, Artificial Sequence
  Description of Artificial Sequence: Synthetic oligonucleotide
aggttgggatcggttgcaatgct

SEQ ID NO: 2213 - DNA, 22 bp, Artificial Sequence
  Description of Artificial Sequence: Synthetic oligonucleotide
tattgcacttgtcccggcctgt

SEQ ID NO: 2214 - DNA, 22 bp, Artificial Sequence
  Description of Artificial Sequence: Synthetic oligonucleotide
tattgcacttgtcccggcctgt

SEQ ID NO: 2215 - DNA, 19 bp, Artificial Sequence
  Description of Artificial Sequence: Synthetic oligonucleotide
tattgcactcgtcccggcc

SEQ ID NO: 2216 - DNA, 23 bp, Artificial Sequence
  Description of Artificial Sequence: Synthetic oligonucleotide
caaagtgctgttcgtgcaggtag

SEQ ID NO: 2217 - DNA, 22 bp, Artificial Sequence
  Description of Artificial Sequence: Synthetic oligonucleotide
tgaggtagtaagttgtattgtt

SEQ ID NO: 2218 - DNA, 21 bp, Artificial Sequence
  Description of Artificial Sequence: Synthetic oligonucleotide
cccataaagtagaaagcacta

SEQ ID NO: 2219 - DNA, 21 bp, Artificial Sequence
  Description of Artificial Sequence: Synthetic oligonucleotide
accaatattactgtgctgctt

SEQ ID NO: 2220 - DNA, 23 bp, Artificial Sequence
  Description of Artificial Sequence: Synthetic oligonucleotide
acattcattgctgtcggtgggtt

SEQ ID NO: 2221 - DNA, 23 bp, Artificial Sequence
  Description of Artificial Sequence: Synthetic oligonucleotide
acattcattgctgtcggtgggtt

SEQ ID NO: 2222 - DNA, 18 bp, Artificial Sequence
  Description of Artificial Sequence: Synthetic oligonucleotide
tgaggtagtaggttgtat

SEQ ID NO: 2223 - DNA, 21 bp, Artificial Sequence
  Description of Artificial Sequence: Synthetic oligonucleotide
ctatacgacctgctgcctttc

SEQ ID NO: 2224 - DNA, 22 bp, Artificial Sequence
  Description of Artificial Sequence: Synthetic oligonucleotide
catcgggaatgtcgtgtccgcc

SEQ ID NO: 2225 - DNA, 24 bp, Artificial Sequence
  Description of Artificial Sequence: Synthetic oligonucleotide
aatgacacgatcactcccgttgag

SEQ ID NO: 2226 - DNA, 17 bp, Artificial Sequence
  Description of Artificial Sequence: Synthetic oligonucleotide
cccgggtttcggcacca

SEQ ID NO: 2227 - DNA, 17 bp, Artificial Sequence
  Description of Artificial Sequence: Synthetic oligonucleotide
cccgggtttcggcacca

SEQ ID NO: 2228 - DNA, 20 bp, Artificial Sequence
  Description of Artificial Sequence: Synthetic oligonucleotide
gccgggtactttcgtatttt

SEQ ID NO: 2229 - DNA, 26 bp, Artificial Sequence
  Description of Artificial Sequence: Synthetic oligonucleotide
gctaaggaagtcctgtgctcagtttt

SEQ ID NO: 2230 - DNA, 22 bp, Artificial Sequence
  Description of Artificial Sequence: Synthetic oligonucleotide
tcgattcccggcccatgcacca

SEQ ID NO: 2231 - DNA, 22 bp, Artificial Sequence
  Description of Artificial Sequence: Synthetic oligonucleotide
tcgattcccggcccatgcacca

SEQ ID NO: 2232 - DNA, 22 bp, Artificial Sequence
  Description of Artificial Sequence: Synthetic oligonucleotide
tcgattcccggcccatgcacca

SEQ ID NO: 2233 - DNA, 22 bp, Artificial Sequence
  Description of Artificial Sequence: Synthetic oligonucleotide
tcgattcccggcccatgcacca

SEQ ID NO: 2234 - DNA, 22 bp, Artificial Sequence
  Description of Artificial Sequence: Synthetic oligonucleotide
tcgattcccggcccatgcacca

SEQ ID NO: 2235 - DNA, 22 bp, Artificial Sequence
  Description of Artificial Sequence: Synthetic oligonucleotide
tcgattcccggcccatgcacca

SEQ ID NO: 2236 - DNA, 17 bp, Artificial Sequence
  Description of Artificial Sequence: Synthetic oligonucleotide
agaaaggccgaatttta

SEQ ID NO: 2237 - DNA, 19 bp, Artificial Sequence
  Description of Artificial Sequence: Synthetic oligonucleotide
tggtgtggtctgttgtttt

SEQ ID NO: 2238 - DNA, 27 bp, Artificial Sequence
  Description of Artificial Sequence: Synthetic oligonucleotide
ccccccactgctaaatttgactggctt

SEQ ID NO: 2239 - DNA, 27 bp, Artificial Sequence
  Description of Artificial Sequence: Synthetic oligonucleotide
ccccccactgctaaatttgactggctt

SEQ ID NO: 2240 - DNA, 17 bp, Artificial Sequence
  Description of Artificial Sequence: Synthetic oligonucleotide
tccccgcacctccacca

SEQ ID NO: 2241 - DNA, 17 bp, Artificial Sequence
  Description of Artificial Sequence: Synthetic oligonucleotide
gagagcgctcggttttt

SEQ ID NO: 2242 - DNA, 18 bp, Artificial Sequence
  Description of Artificial Sequence: Synthetic oligonucleotide
atcccactcctgacacca

SEQ ID NO: 2243 - DNA, 19 bp, Artificial Sequence
  Description of Artificial Sequence: Synthetic oligonucleotide
ggcgtgattcatacctttt

SEQ ID NO: 2244 - DNA, 17 bp, Artificial Sequence
  Description of Artificial Sequence: Synthetic oligonucleotide
agggtgtgcgtgttttt

SEQ ID NO: 2245 - DNA, 28 bp, Artificial Sequence
  Description of Artificial Sequence: Synthetic oligonucleotide
aaccgagcgtccaagctctttccatttt

SEQ ID NO: 2246 - DNA, 18 bp, Artificial Sequence
  Description of Artificial Sequence: Synthetic oligonucleotide
tccccgacacctccacca

SEQ ID NO: 2247 - DNA, 17 bp, Artificial Sequence
  Description of Artificial Sequence: Synthetic oligonucleotide
gcccgcatcctccacca

SEQ ID NO: 2248 - DNA, 18 bp, Artificial Sequence
  Description of Artificial Sequence: Synthetic oligonucleotide
atgtggtggcttactttt

SEQ ID NO: 2249 - DNA, 18 bp, Artificial Sequence
  Description of Artificial Sequence: Synthetic oligonucleotide
tccccggcacttccacca

SEQ ID NO: 2250 - DNA, 17 bp, Artificial Sequence
  Description of Artificial Sequence: Synthetic oligonucleotide
tcaccccataaacacca

SEQ ID NO: 2251 - DNA, 18 bp, Artificial Sequence
  Description of Artificial Sequence: Synthetic oligonucleotide
ttccccgacggggagcca

SEQ ID NO: 2252 - DNA, 18 bp, Artificial Sequence
  Description of Artificial Sequence: Synthetic oligonucleotide
ttccccgacggggagcca

SEQ ID NO: 2253 - DNA, 18 bp, Artificial Sequence
  Description of Artificial Sequence: Synthetic oligonucleotide
ttccccgacggggagcca

SEQ ID NO: 2254 - DNA, 18 bp, Artificial Sequence
  Description of Artificial Sequence: Synthetic oligonucleotide
ttccccgacggggagcca

SEQ ID NO: 2255 - DNA, 18 bp, Artificial Sequence
  Description of Artificial Sequence: Synthetic oligonucleotide
ttccccgacggggagcca

SEQ ID NO: 2256 - DNA, 23 bp, Artificial Sequence
  Description of Artificial Sequence: Synthetic oligonucleotide
tgtgctccggagttacctcgttt

SEQ ID NO: 2257 - DNA, 17 bp, Artificial Sequence
  Description of Artificial Sequence: Synthetic oligonucleotide
tcacgtcggggtcacca

SEQ ID NO: 2258 - DNA, 19 bp, Artificial Sequence
  Description of Artificial Sequence: Synthetic oligonucleotide
agtcccatctgggtcgcca

SEQ ID NO: 2259 - DNA, 19 bp, Artificial Sequence
  Description of Artificial Sequence: Synthetic oligonucleotide
agtcccatctgggtcgcca

SEQ ID NO: 2260 - DNA, 19 bp, Artificial Sequence
  Description of Artificial Sequence: Synthetic oligonucleotide
agtcccatctgggtcgcca

SEQ ID NO: 2261 - DNA, 19 bp, Artificial Sequence
  Description of Artificial Sequence: Synthetic oligonucleotide
agtcccatctgggtcgcca

SEQ ID NO: 2262 - DNA, 19 bp, Artificial Sequence
  Description of Artificial Sequence: Synthetic oligonucleotide
agtcccatctgggtcgcca

SEQ ID NO: 2263 - DNA, 19 bp, Artificial Sequence
  Description of Artificial Sequence: Synthetic oligonucleotide
agtcccatctgggtcgcca

SEQ ID NO: 2264 - DNA, 19 bp, Artificial Sequence
  Description of Artificial Sequence: Synthetic oligonucleotide
agtcccatctgggtcgcca

SEQ ID NO: 2265 - DNA, 19 bp, Artificial Sequence
  Description of Artificial Sequence: Synthetic oligonucleotide
agtcccatctgggtcgcca

SEQ ID NO: 2266 - DNA, 19 bp, Artificial Sequence
  Description of Artificial Sequence: Synthetic oligonucleotide
agtcccatctgggtcgcca

SEQ ID NO: 2267 - DNA, 19 bp, Artificial Sequence
  Description of Artificial Sequence: Synthetic oligonucleotide
agtcccatctgggtcgcca

SEQ ID NO: 2268 - DNA, 19 bp, Artificial Sequence
  Description of Artificial Sequence: Synthetic oligonucleotide
agtcccatctgggtcgcca

SEQ ID NO: 2269 - DNA, 19 bp, Artificial Sequence
  Description of Artificial Sequence: Synthetic oligonucleotide
agtcccatctgggtcgcca

SEQ ID NO: 2270 - DNA, 19 bp, Artificial Sequence
  Description of Artificial Sequence: Synthetic oligonucleotide
agtcccatctgggtcgcca

SEQ ID NO: 2271 - DNA, 19 bp, Artificial Sequence
  Description of Artificial Sequence: Synthetic oligonucleotide
agtcccatctgggtcgcca

SEQ ID NO: 2272 - DNA, 19 bp, Artificial Sequence
  Description of Artificial Sequence: Synthetic oligonucleotide
agtcccatctgggtcgcca

SEQ ID NO: 2273 - DNA, 19 bp, Artificial Sequence
  Description of Artificial Sequence: Synthetic oligonucleotide
agtcccatctgggtcgcca

SEQ ID NO: 2274 - DNA, 19 bp, Artificial Sequence
  Description of Artificial Sequence: Synthetic oligonucleotide
agtcccatctgggtcgcca

SEQ ID NO: 2275 - DNA, 18 bp, Artificial Sequence
  Description of Artificial Sequence: Synthetic oligonucleotide
tccccgtacgggccacca

SEQ ID NO: 2276 - DNA, 18 bp, Artificial Sequence
  Description of Artificial Sequence: Synthetic oligonucleotide
tccccgtacgggccacca

SEQ ID NO: 2277 - DNA, 18 bp, Artificial Sequence
  Description of Artificial Sequence: Synthetic oligonucleotide
gtcccttcgtggtcgcca

SEQ ID NO: 2278 - DNA, 18 bp, Artificial Sequence
  Description of Artificial Sequence: Synthetic oligonucleotide
gtcccttcgtggtcgcca

SEQ ID NO: 2279 - DNA, 18 bp, Artificial Sequence
  Description of Artificial Sequence: Synthetic oligonucleotide
gtcccttcgtggtcgcca

SEQ ID NO: 2280 - DNA, 18 bp, Artificial Sequence
  Description of Artificial Sequence: Synthetic oligonucleotide
gtcccttcgtggtcgcca

SEQ ID NO: 2281 - DNA, 18 bp, Artificial Sequence
  Description of Artificial Sequence: Synthetic oligonucleotide
gtcccttcgtggtcgcca

SEQ ID NO: 2282 - DNA, 18 bp, Artificial Sequence
  Description of Artificial Sequence: Synthetic oligonucleotide
gtcccttcgtggtcgcca

SEQ ID NO: 2283 - DNA, 18 bp, Artificial Sequence
  Description of Artificial Sequence: Synthetic oligonucleotide
gtcccttcgtggtcgcca

SEQ ID NO: 2284 - DNA, 18 bp, Artificial Sequence
  Description of Artificial Sequence: Synthetic oligonucleotide
gtcccttcgtggtcgcca

SEQ ID NO: 2285 - DNA, 18 bp, Artificial Sequence
  Description of Artificial Sequence: Synthetic oligonucleotide
gtcccttcgtggtcgcca

SEQ ID NO: 2286 - DNA, 21 bp, Artificial Sequence
  Description of Artificial Sequence: Synthetic oligonucleotide
gtcaggatggccgagcggtct

SEQ ID NO: 2287 - DNA, 21 bp, Artificial Sequence
  Description of Artificial Sequence: Synthetic oligonucleotide
gtcaggatggccgagcggtct

SEQ ID NO: 2288 - DNA, 21 bp, Artificial Sequence
  Description of Artificial Sequence: Synthetic oligonucleotide
gtcaggatggccgagcggtct

SEQ ID NO: 2289 - DNA, 21 bp, Artificial Sequence
  Description of Artificial Sequence: Synthetic oligonucleotide
gtcaggatggccgagcggtct

SEQ ID NO: 2290 - DNA, 21 bp, Artificial Sequence
  Description of Artificial Sequence: Synthetic oligonucleotide
gtcaggatggccgagcggtct

SEQ ID NO: 2291 - DNA, 21 bp, Artificial Sequence
  Description of Artificial Sequence: Synthetic oligonucleotide
gtcaggatggccgagcggtct

SEQ ID NO: 2292 - DNA, 21 bp, Artificial Sequence
  Description of Artificial Sequence: Synthetic oligonucleotide
gtcaggatggccgagcggtct

SEQ ID NO: 2293 - DNA, 21 bp, Artificial Sequence
  Description of Artificial Sequence: Synthetic oligonucleotide
gtcaggatggccgagcggtct

SEQ ID NO: 2294 - DNA, 17 bp, Artificial Sequence
  Description of Artificial Sequence: Synthetic oligonucleotide
aggggggtaaaaaaaaa

SEQ ID NO: 2295 - DNA, 17 bp, Artificial Sequence
  Description of Artificial Sequence: Synthetic oligonucleotide
aggggggtaaaaaaaaa

SEQ ID NO: 2296 - DNA, 17 bp, Artificial Sequence
  Description of Artificial Sequence: Synthetic oligonucleotide
cccacccagggacgcca

SEQ ID NO: 2297 - DNA, 17 bp, Artificial Sequence
  Description of Artificial Sequence: Synthetic oligonucleotide
cccacccagggacgcca

SEQ ID NO: 2298 - DNA, 17 bp, Artificial Sequence
  Description of Artificial Sequence: Synthetic oligonucleotide
cccacccagggacgcca

SEQ ID NO: 2299 - DNA, 17 bp, Artificial Sequence
  Description of Artificial Sequence: Synthetic oligonucleotide
cccacccagggacgcca

SEQ ID NO: 2300 - DNA, 17 bp, Artificial Sequence
  Description of Artificial Sequence: Synthetic oligonucleotide
cccacccagggacgcca

SEQ ID NO: 2301 - DNA, 18 bp, Artificial Sequence
  Description of Artificial Sequence: Synthetic oligonucleotide
tccccggcacctccacca

SEQ ID NO: 2302 - DNA, 18 bp, Artificial Sequence
  Description of Artificial Sequence: Synthetic oligonucleotide
gagggggaccaaaaaaaa

SEQ ID NO: 2303 - DNA, 19 bp, Artificial Sequence
  Description of Artificial Sequence: Synthetic oligonucleotide
taccgagcctggtgatagc

SEQ ID NO: 2304 - DNA, 19 bp, Artificial Sequence
  Description of Artificial Sequence: Synthetic oligonucleotide
taccgagcctggtgatagc

SEQ ID NO: 2305 - DNA, 22 bp, Artificial Sequence
  Description of Artificial Sequence: Synthetic oligonucleotide
tcgattcccggccaatgcacca

SEQ ID NO: 2306 - DNA, 22 bp, Artificial Sequence
  Description of Artificial Sequence: Synthetic oligonucleotide
tcgattcccggccaatgcacca

SEQ ID NO: 2307 - DNA, 23 bp, Artificial Sequence
  Description of Artificial Sequence: Synthetic oligonucleotide
gagccatgatgataccactgagc

SEQ ID NO: 2308 - DNA, 17 bp, Artificial Sequence
  Description of Artificial Sequence: Synthetic oligonucleotide
taacggccgcggtaccc

SEQ ID NO: 2309 - DNA, 17 bp, Artificial Sequence
  Description of Artificial Sequence: Synthetic oligonucleotide
taacggccgcggtaccc

SEQ ID NO: 2310 - DNA, 23 bp, Artificial Sequence
  Description of Artificial Sequence: Synthetic oligonucleotide
gcagcgccagcctcccgccctac

SEQ ID NO: 2311 - DNA, 19 bp, Artificial Sequence
  Description of Artificial Sequence: Synthetic oligonucleotide
cgtccatgatgttccgcaa

SEQ ID NO: 2312 - DNA, 27 bp, Artificial Sequence
  Description of Artificial Sequence: Synthetic oligonucleotide
agcagtgatgtcctgaaaattctgaag

SEQ ID NO: 2313 - DNA, 20 bp, Artificial Sequence
  Description of Artificial Sequence: Synthetic oligonucleotide
aaaggacctggcggtgcttc

SEQ ID NO: 2314 - DNA, 20 bp, Artificial Sequence
  Description of Artificial Sequence: Synthetic oligonucleotide
aaaggacctggcggtgcttc

SEQ ID NO: 2315 - DNA, 20 bp, Artificial Sequence
  Description of Artificial Sequence: Synthetic oligonucleotide
aaaggacctggcggtgcttc

SEQ ID NO: 2316 - DNA, 18 bp, Artificial Sequence
  Description of Artificial Sequence: Synthetic oligonucleotide
atcccggacgagccccca

SEQ ID NO: 2317 - DNA, 18 bp, Artificial Sequence
  Description of Artificial Sequence: Synthetic oligonucleotide
atcccggacgagccccca

SEQ ID NO: 2318 - DNA, 18 bp, Artificial Sequence
  Description of Artificial Sequence: Synthetic oligonucleotide
atcccggacgagccccca

SEQ ID NO: 2319 - DNA, 18 bp, Artificial Sequence
  Description of Artificial Sequence: Synthetic oligonucleotide
atcccggacgagccccca

SEQ ID NO: 2320 - DNA, 18 bp, Artificial Sequence
  Description of Artificial Sequence: Synthetic oligonucleotide
atcccggacgagccccca

SEQ ID NO: 2321 - DNA, 18 bp, Artificial Sequence
  Description of Artificial Sequence: Synthetic oligonucleotide
tcctcacacggggcacca

SEQ ID NO: 2322 - DNA, 18 bp, Artificial Sequence
  Description of Artificial Sequence: Synthetic oligonucleotide
tcctcacacggggcacca

SEQ ID NO: 2323 - DNA, 18 bp, Artificial Sequence
  Description of Artificial Sequence: Synthetic oligonucleotide
atcccacttctgacacca

SEQ ID NO: 2324 - DNA, 18 bp, Artificial Sequence
  Description of Artificial Sequence: Synthetic oligonucleotide
atcccacttctgacacca

SEQ ID NO: 2325 - DNA, 18 bp, Artificial Sequence
  Description of Artificial Sequence: Synthetic oligonucleotide
atcccacttctgacacca

SEQ ID NO: 2326 - DNA, 18 bp, Artificial Sequence
  Description of Artificial Sequence: Synthetic oligonucleotide
atcccacttctgacacca

SEQ ID NO: 2327 - DNA, 18 bp, Artificial Sequence
  Description of Artificial Sequence: Synthetic oligonucleotide
atcccacttctgacacca

SEQ ID NO: 2328 - DNA, 18 bp, Artificial Sequence
  Description of Artificial Sequence: Synthetic oligonucleotide
atcccacttctgacacca

SEQ ID NO: 2329 - DNA, 18 bp, Artificial Sequence
  Description of Artificial Sequence: Synthetic oligonucleotide
atcccacttctgacacca

SEQ ID NO: 2330 - DNA, 18 bp, Artificial Sequence
  Description of Artificial Sequence: Synthetic oligonucleotide
atcccacttctgacacca

SEQ ID NO: 2331 - DNA, 18 bp, Artificial Sequence
  Description of Artificial Sequence: Synthetic oligonucleotide
atcccacttctgacacca

SEQ ID NO: 2332 - DNA, 20 bp, Artificial Sequence
  Description of Artificial Sequence: Synthetic oligonucleotide
accccactatgcttagccct

SEQ ID NO: 2333 - DNA, 17 bp, Artificial Sequence
  Description of Artificial Sequence: Synthetic oligonucleotide
tgtattgtgagacattc

SEQ ID NO: 2334 - DNA, 17 bp, Artificial Sequence
  Description of Artificial Sequence: Synthetic oligonucleotide
tctcggtggaacctcca

SEQ ID NO: 2335 - DNA, 17 bp, Artificial Sequence
  Description of Artificial Sequence: Synthetic oligonucleotide
tctcggtggaacctcca

SEQ ID NO: 2336 - DNA, 19 bp, Artificial Sequence
  Description of Artificial Sequence: Synthetic oligonucleotide
atccccagcacctccacca

SEQ ID NO: 2337 - DNA, 18 bp, Artificial Sequence
  Description of Artificial Sequence: Synthetic oligonucleotide
agaacactacgagccaca

SEQ ID NO: 2338 - DNA, 18 bp, Artificial Sequence
  Description of Artificial Sequence: Synthetic oligonucleotide
agaacactacgagccaca

SEQ ID NO: 2339 - DNA, 18 bp, Artificial Sequence
  Description of Artificial Sequence: Synthetic oligonucleotide
agaacactacgagccaca

SEQ ID NO: 2340 - DNA, 18 bp, Artificial Sequence
  Description of Artificial Sequence: Synthetic oligonucleotide
accccacttctggtacca

SEQ ID NO: 2341 - DNA, 18 bp, Artificial Sequence
  Description of Artificial Sequence: Synthetic oligonucleotide
accccacttctggtacca

SEQ ID NO: 2342 - DNA, 18 bp, Artificial Sequence
  Description of Artificial Sequence: Synthetic oligonucleotide
accccacttctggtacca

SEQ ID NO: 2343 - DNA, 18 bp, Artificial Sequence
  Description of Artificial Sequence: Synthetic oligonucleotide
accccacttctggtacca

SEQ ID NO: 2344 - DNA, 18 bp, Artificial Sequence
  Description of Artificial Sequence: Synthetic oligonucleotide
accccacttctggtacca

SEQ ID NO: 2345 - DNA, 18 bp, Artificial Sequence
  Description of Artificial Sequence: Synthetic oligonucleotide
accccacttctggtacca

SEQ ID NO: 2346 - DNA, 18 bp, Artificial Sequence
  Description of Artificial Sequence: Synthetic oligonucleotide
accccacttctggtacca

SEQ ID NO: 2347 - DNA, 18 bp, Artificial Sequence
  Description of Artificial Sequence: Synthetic oligonucleotide
accccacttctggtacca

SEQ ID NO: 2348 - DNA, 18 bp, Artificial Sequence
  Description of Artificial Sequence: Synthetic oligonucleotide
accccacttctggtacca

SEQ ID NO: 2349 - DNA, 18 bp, Artificial Sequence
  Description of Artificial Sequence: Synthetic oligonucleotide
accccacttctggtacca

SEQ ID NO: 2350 - DNA, 18 bp, Artificial Sequence
  Description of Artificial Sequence: Synthetic oligonucleotide
accccacttctggtacca

SEQ ID NO: 2351 - DNA, 18 bp, Artificial Sequence
  Description of Artificial Sequence: Synthetic oligonucleotide
accccacttctggtacca

SEQ ID NO: 2352 - DNA, 18 bp, Artificial Sequence
  Description of Artificial Sequence: Synthetic oligonucleotide
accccacttctggtacca

SEQ ID NO: 2353 - DNA, 18 bp, Artificial Sequence
  Description of Artificial Sequence: Synthetic oligonucleotide
accccacttctggtacca

SEQ ID NO: 2354 - DNA, 18 bp, Artificial Sequence
  Description of Artificial Sequence: Synthetic oligonucleotide
accccacttctggtacca

SEQ ID NO: 2355 - DNA, 18 bp, Artificial Sequence
  Description of Artificial Sequence: Synthetic oligonucleotide
accccacttctggtacca

SEQ ID NO: 2356 - DNA, 18 bp, Artificial Sequence
  Description of Artificial Sequence: Synthetic oligonucleotide
accccacttctggtacca

SEQ ID NO: 2357 - DNA, 18 bp, Artificial Sequence
  Description of Artificial Sequence: Synthetic oligonucleotide
accccacttctggtacca

SEQ ID NO: 2358 - DNA, 18 bp, Artificial Sequence
  Description of Artificial Sequence: Synthetic oligonucleotide
accccacttctggtacca

SEQ ID NO: 2359 - DNA, 18 bp, Artificial Sequence
  Description of Artificial Sequence: Synthetic oligonucleotide
accccacttctggtacca

SEQ ID NO: 2360 - DNA, 18 bp, Artificial Sequence
  Description of Artificial Sequence: Synthetic oligonucleotide
accccacttctggtacca

SEQ ID NO: 2361 - DNA, 18 bp, Artificial Sequence
  Description of Artificial Sequence: Synthetic oligonucleotide
accccacttctggtacca

SEQ ID NO: 2362 - DNA, 18 bp, Artificial Sequence
  Description of Artificial Sequence: Synthetic oligonucleotide
accccacttctggtacca

SEQ ID NO: 2363 - DNA, 18 bp, Artificial Sequence
  Description of Artificial Sequence: Synthetic oligonucleotide
accccacttctggtacca

SEQ ID NO: 2364 - DNA, 18 bp, Artificial Sequence
  Description of Artificial Sequence: Synthetic oligonucleotide
accccacttctggtacca

SEQ ID NO: 2365 - DNA, 18 bp, Artificial Sequence
  Description of Artificial Sequence: Synthetic oligonucleotide
accccacttctggtacca

SEQ ID NO: 2366 - DNA, 18 bp, Artificial Sequence
  Description of Artificial Sequence: Synthetic oligonucleotide
accccacttctggtacca

SEQ ID NO: 2367 - DNA, 18 bp, Artificial Sequence
  Description of Artificial Sequence: Synthetic oligonucleotide
accccacttctggtacca

SEQ ID NO: 2368 - DNA, 18 bp, Artificial Sequence
  Description of Artificial Sequence: Synthetic oligonucleotide
accccacttctggtacca

SEQ ID NO: 2369 - DNA, 18 bp, Artificial Sequence
  Description of Artificial Sequence: Synthetic oligonucleotide
accccacttctggtacca

SEQ ID NO: 2370 - DNA, 18 bp, Artificial Sequence
  Description of Artificial Sequence: Synthetic oligonucleotide
accccacttctggtacca

SEQ ID NO: 2371 - DNA, 18 bp, Artificial Sequence
  Description of Artificial Sequence: Synthetic oligonucleotide
accccacttctggtacca

SEQ ID NO: 2372 - DNA, 18 bp, Artificial Sequence
  Description of Artificial Sequence: Synthetic oligonucleotide
accccacttctggtacca

SEQ ID NO: 2373 - DNA, 18 bp, Artificial Sequence
  Description of Artificial Sequence: Synthetic oligonucleotide
cgttcgcgctttcccctg

SEQ ID NO: 2374 - DNA, 18 bp, Artificial Sequence
  Description of Artificial Sequence: Synthetic oligonucleotide
cgttcgcgctttcccctg

SEQ ID NO: 2375 - DNA, 18 bp, Artificial Sequence
  Description of Artificial Sequence: Synthetic oligonucleotide
cgttcgcgctttcccctg

SEQ ID NO: 2376 - DNA, 18 bp, Artificial Sequence
  Description of Artificial Sequence: Synthetic oligonucleotide
cgttcgcgctttcccctg

SEQ ID NO: 2377 - DNA, 18 bp, Artificial Sequence
  Description of Artificial Sequence: Synthetic oligonucleotide
gacgaggtggccgagtgg

SEQ ID NO: 2378 - DNA, 18 bp, Artificial Sequence
  Description of Artificial Sequence: Synthetic oligonucleotide
gacgaggtggccgagtgg

SEQ ID NO: 2379 - DNA, 18 bp, Artificial Sequence
  Description of Artificial Sequence: Synthetic oligonucleotide
gacgaggtggccgagtgg

SEQ ID NO: 2380 - DNA, 18 bp, Artificial Sequence
  Description of Artificial Sequence: Synthetic oligonucleotide
gacgaggtggccgagtgg

SEQ ID NO: 2381 - DNA, 18 bp, Artificial Sequence
  Description of Artificial Sequence: Synthetic oligonucleotide
gacgaggtggccgagtgg

SEQ ID NO: 2382 - DNA, 18 bp, Artificial Sequence
  Description of Artificial Sequence: Synthetic oligonucleotide
gacgaggtggccgagtgg

SEQ ID NO: 2383 - DNA, 18 bp, Artificial Sequence
  Description of Artificial Sequence: Synthetic oligonucleotide
gacgaggtggccgagtgg

SEQ ID NO: 2384 - DNA, 18 bp, Artificial Sequence
  Description of Artificial Sequence: Synthetic oligonucleotide
gacgaggtggccgagtgg

SEQ ID NO: 2385 - DNA, 18 bp, Artificial Sequence
  Description of Artificial Sequence: Synthetic oligonucleotide
tccccggcatctccacca

SEQ ID NO: 2386 - DNA, 20 bp, Artificial Sequence
  Description of Artificial Sequence: Synthetic oligonucleotide
ctgattgctcctgtctgatt

SEQ ID NO: 2387 - DNA, 21 bp, Artificial Sequence
  Description of Artificial Sequence: Synthetic oligonucleotide
tctagaggagcctgttctgta

SEQ ID NO: 2388 - DNA, 22 bp, Artificial Sequence
  Description of Artificial Sequence: Synthetic oligonucleotide
tcgggtgcgagaggtcccgggt

SEQ ID NO: 2389 - DNA, 23 bp, Artificial Sequence
  Description of Artificial Sequence: Synthetic oligonucleotide
ataggtttggtcctagcctttct

SEQ ID NO: 2390 - DNA, 22 bp, Artificial Sequence
  Description of Artificial Sequence: Synthetic oligonucleotide
tcgattcccggtcagggaacca

SEQ ID NO: 2391 - DNA, 28 bp, Artificial Sequence
  Description of Artificial Sequence: Synthetic oligonucleotide
tcctcgttagtatagtggtgagtatccc

SEQ ID NO: 2392 - DNA, 28 bp, Artificial Sequence
  Description of Artificial Sequence: Synthetic oligonucleotide
tcctcgttagtatagtggtgagtatccc

SEQ ID NO: 2393 - DNA, 28 bp, Artificial Sequence
  Description of Artificial Sequence: Synthetic oligonucleotide
tcctcgttagtatagtggtgagtatccc

SEQ ID NO: 2394 - DNA, 28 bp, Artificial Sequence
  Description of Artificial Sequence: Synthetic oligonucleotide
tcctcgttagtatagtggtgagtatccc

SEQ ID NO: 2395 - DNA, 28 bp, Artificial Sequence
  Description of Artificial Sequence: Synthetic oligonucleotide
tcctcgttagtatagtggtgagtatccc

SEQ ID NO: 2396 - DNA, 28 bp, Artificial Sequence
  Description of Artificial Sequence: Synthetic oligonucleotide
tcctcgttagtatagtggtgagtatccc

SEQ ID NO: 2397 - DNA, 28 bp, Artificial Sequence
  Description of Artificial Sequence: Synthetic oligonucleotide
tcctcgttagtatagtggtgagtatccc

SEQ ID NO: 2398 - DNA, 28 bp, Artificial Sequence
  Description of Artificial Sequence: Synthetic oligonucleotide
tcctcgttagtatagtggtgagtatccc

SEQ ID NO: 2399 - DNA, 28 bp, Artificial Sequence
  Description of Artificial Sequence: Synthetic oligonucleotide
tcctcgttagtatagtggtgagtatccc

SEQ ID NO: 2400 - DNA, 28 bp, Artificial Sequence
  Description of Artificial Sequence: Synthetic oligonucleotide
tcctcgttagtatagtggtgagtatccc

SEQ ID NO: 2401 - DNA, 28 bp, Artificial Sequence
  Description of Artificial Sequence: Synthetic oligonucleotide
tcctcgttagtatagtggtgagtatccc

SEQ ID NO: 2402 - DNA, 28 bp, Artificial Sequence
  Description of Artificial Sequence: Synthetic oligonucleotide
tccctggtggtctagtggttaggattcg

SEQ ID NO: 2403 - DNA, 28 bp, Artificial Sequence
  Description of Artificial Sequence: Synthetic oligonucleotide
tccctggtggtctagtggttaggattcg

SEQ ID NO: 2404 - DNA, 28 bp, Artificial Sequence
  Description of Artificial Sequence: Synthetic oligonucleotide
tccctggtggtctagtggttaggattcg

SEQ ID NO: 2405 - DNA, 28 bp, Artificial Sequence
  Description of Artificial Sequence: Synthetic oligonucleotide
tccctggtggtctagtggttaggattcg

SEQ ID NO: 2406 - DNA, 28 bp, Artificial Sequence
  Description of Artificial Sequence: Synthetic oligonucleotide
tccctggtggtctagtggttaggattcg

SEQ ID NO: 2407 - DNA, 28 bp, Artificial Sequence
  Description of Artificial Sequence: Synthetic oligonucleotide
tccctggtggtctagtggttaggattcg

SEQ ID NO: 2408 - DNA, 28 bp, Artificial Sequence
  Description of Artificial Sequence: Synthetic oligonucleotide
tccctggtggtctagtggttaggattcg

SEQ ID NO: 2409 - DNA, 17 bp, Artificial Sequence
  Description of Artificial Sequence: Synthetic oligonucleotide
taagtgtttgtgggtta

SEQ ID NO: 2410 - DNA, 22 bp, Artificial Sequence
  Description of Artificial Sequence: Synthetic oligonucleotide
gcattggtggttcagtggtaga

SEQ ID NO: 2411 - DNA, 22 bp, Artificial Sequence
  Description of Artificial Sequence: Synthetic oligonucleotide
gcattggtggttcagtggtaga

SEQ ID NO: 2412 - DNA, 22 bp, Artificial Sequence
  Description of Artificial Sequence: Synthetic oligonucleotide
gcattggtggttcagtggtaga

SEQ ID NO: 2413 - DNA, 22 bp, Artificial Sequence
  Description of Artificial Sequence: Synthetic oligonucleotide
gcattggtggttcagtggtaga

SEQ ID NO: 2414 - DNA, 22 bp, Artificial Sequence
  Description of Artificial Sequence: Synthetic oligonucleotide
gcattggtggttcagtggtaga

SEQ ID NO: 2415 - DNA, 22 bp, Artificial Sequence
  Description of Artificial Sequence: Synthetic oligonucleotide
gcattggtggttcagtggtaga

SEQ ID NO: 2416 - DNA, 22 bp, Artificial Sequence
  Description of Artificial Sequence: Synthetic oligonucleotide
gcattggtggttcagtggtaga

SEQ ID NO: 2417 - DNA, 22 bp, Artificial Sequence
  Description of Artificial Sequence: Synthetic oligonucleotide
gcattggtggttcagtggtaga

SEQ ID NO: 2418 - DNA, 22 bp, Artificial Sequence
  Description of Artificial Sequence: Synthetic oligonucleotide
gcattggtggttcagtggtaga

SEQ ID NO: 2419 - DNA, 22 bp, Artificial Sequence
  Description of Artificial Sequence: Synthetic oligonucleotide
gcattggtggttcagtggtaga

SEQ ID NO: 2420 - DNA, 22 bp, Artificial Sequence
  Description of Artificial Sequence: Synthetic oligonucleotide
gcattggtggttcagtggtaga

SEQ ID NO: 2421 - DNA, 17 bp, Artificial Sequence
  Description of Artificial Sequence: Synthetic oligonucleotide
tggttatcacgttcgcc

SEQ ID NO: 2422 - DNA, 17 bp, Artificial Sequence
  Description of Artificial Sequence: Synthetic oligonucleotide
tggttatcacgttcgcc

SEQ ID NO: 2423 - DNA, 17 bp, Artificial Sequence
  Description of Artificial Sequence: Synthetic oligonucleotide
tggttatcacgttcgcc

SEQ ID NO: 2424 - DNA, 17 bp, Artificial Sequence
  Description of Artificial Sequence: Synthetic oligonucleotide
tggttatcacgttcgcc

SEQ ID NO: 2425 - DNA, 17 bp, Artificial Sequence
  Description of Artificial Sequence: Synthetic oligonucleotide
tggttatcacgttcgcc

SEQ ID NO: 2426 - DNA, 17 bp, Artificial Sequence
  Description of Artificial Sequence: Synthetic oligonucleotide
ccctgctcgctgcgcca

SEQ ID NO: 2427 - DNA, 22 bp, Artificial Sequence
  Description of Artificial Sequence: Synthetic oligonucleotide
ttctcactactgcacttgacta

SEQ ID NO: 2428 - DNA, 22 bp, Artificial Sequence
  Description of Artificial Sequence: Synthetic oligonucleotide
ttctcactactgcacttgacta

SEQ ID NO: 2429 - DNA, 22 bp, Artificial Sequence
  Description of Artificial Sequence: Synthetic oligonucleotide
ttctcactactgcacttgacta

SEQ ID NO: 2430 - DNA, 22 bp, Artificial Sequence
  Description of Artificial Sequence: Synthetic oligonucleotide
ttctcactactgcacttgacta

SEQ ID NO: 2431 - DNA, 18 bp, Artificial Sequence
  Description of Artificial Sequence: Synthetic oligonucleotide
ctcctggctggctcgcca

SEQ ID NO: 2432 - DNA, 18 bp, Artificial Sequence
  Description of Artificial Sequence: Synthetic oligonucleotide
ctcctggctggctcgcca

SEQ ID NO: 2433 - DNA, 24 bp, Artificial Sequence
  Description of Artificial Sequence: Synthetic oligonucleotide
ctcccactgcttcacttgactagc

SEQ ID NO: 2434 - DNA, 24 bp, Artificial Sequence
  Description of Artificial Sequence: Synthetic oligonucleotide
ctcccactgcttcacttgactagc

SEQ ID NO: 2435 - DNA, 24 bp, Artificial Sequence
  Description of Artificial Sequence: Synthetic oligonucleotide
ctcccactgcttcacttgactagc

SEQ ID NO: 2436 - DNA, 24 bp, Artificial Sequence
  Description of Artificial Sequence: Synthetic oligonucleotide
ctcccactgcttcacttgactagc

SEQ ID NO: 2437 - DNA, 24 bp, Artificial Sequence
  Description of Artificial Sequence: Synthetic oligonucleotide
ctcccactgcttcacttgactagc

SEQ ID NO: 2438 - DNA, 24 bp, Artificial Sequence
  Description of Artificial Sequence: Synthetic oligonucleotide
ctcccactgcttcacttgactagc

SEQ ID NO: 2439 - DNA, 17 bp, Artificial Sequence
  Description of Artificial Sequence: Synthetic oligonucleotide
ctgctgtgatgacattc

SEQ ID NO: 2440 - DNA, 17 bp, Artificial Sequence
  Description of Artificial Sequence: Synthetic oligonucleotide
tcctgccgcggtcgcca

SEQ ID NO: 2441 - DNA, 27 bp, Artificial Sequence
  Description of Artificial Sequence: Synthetic oligonucleotide
gcgggtgatgcgaactggagtctgagc

SEQ ID NO: 2442 - DNA, 24 bp, Artificial Sequence
  Description of Artificial Sequence: Synthetic oligonucleotide
cccccacaaccgcgcttgactagc

SEQ ID NO: 2443 - DNA, 19 bp, Artificial Sequence
  Description of Artificial Sequence: Synthetic oligonucleotide
taggggtatgattctcgct

SEQ ID NO: 2444 - DNA, 19 bp, Artificial Sequence
  Description of Artificial Sequence: Synthetic oligonucleotide
taggggtatgattctcgct

SEQ ID NO: 2445 - DNA, 19 bp, Artificial Sequence
  Description of Artificial Sequence: Synthetic oligonucleotide
taggggtatgattctcgct

SEQ ID NO: 2446 - DNA, 19 bp, Artificial Sequence
  Description of Artificial Sequence: Synthetic oligonucleotide
taggggtatgattctcgct

SEQ ID NO: 2447 - DNA, 19 bp, Artificial Sequence
  Description of Artificial Sequence: Synthetic oligonucleotide
taggggtatgattctcgct

SEQ ID NO: 2448 - DNA, 19 bp, Artificial Sequence
  Description of Artificial Sequence: Synthetic oligonucleotide
taggggtatgattctcgct

SEQ ID NO: 2449 - DNA, 19 bp, Artificial Sequence
  Description of Artificial Sequence: Synthetic oligonucleotide
taggggtatgattctcgct

SEQ ID NO: 2450 - DNA, 19 bp, Artificial Sequence
  Description of Artificial Sequence: Synthetic oligonucleotide
taggggtatgattctcgct

SEQ ID NO: 2451 - DNA, 19 bp, Artificial Sequence
  Description of Artificial Sequence: Synthetic oligonucleotide
taggggtatgattctcgct

SEQ ID NO: 2452 - DNA, 19 bp, Artificial Sequence
  Description of Artificial Sequence: Synthetic oligonucleotide
taggggtatgattctcgct

SEQ ID NO: 2453 - DNA, 19 bp, Artificial Sequence
  Description of Artificial Sequence: Synthetic oligonucleotide
taggggtatgattctcgct

SEQ ID NO: 2454 - DNA, 19 bp, Artificial Sequence
  Description of Artificial Sequence: Synthetic oligonucleotide
taggggtatgattctcgct

SEQ ID NO: 2455 - DNA, 19 bp, Artificial Sequence
  Description of Artificial Sequence: Synthetic oligonucleotide
taggggtatgattctcgct

SEQ ID NO: 2456 - DNA, 19 bp, Artificial Sequence
  Description of Artificial Sequence: Synthetic oligonucleotide
taggggtatgattctcgct

SEQ ID NO: 2457 - DNA, 19 bp, Artificial Sequence
  Description of Artificial Sequence: Synthetic oligonucleotide
taggggtatgattctcgct

SEQ ID NO: 2458 - DNA, 19 bp, Artificial Sequence
  Description of Artificial Sequence: Synthetic oligonucleotide
taggggtatgattctcgct

SEQ ID NO: 2459 - DNA, 26 bp, Artificial Sequence
  Description of Artificial Sequence: Synthetic oligonucleotide
ggctggtccgagtgcagtggtgttta

SEQ ID NO: 2460 - DNA, 26 bp, Artificial Sequence
  Description of Artificial Sequence: Synthetic oligonucleotide
ggctggtccgagtgcagtggtgttta

SEQ ID NO: 2461 - DNA, 26 bp, Artificial Sequence
  Description of Artificial Sequence: Synthetic oligonucleotide
ggctggtccgagtgcagtggtgttta

SEQ ID NO: 2462 - DNA, 26 bp, Artificial Sequence
  Description of Artificial Sequence: Synthetic oligonucleotide
ggctggtccgagtgcagtggtgttta

SEQ ID NO: 2463 - DNA, 26 bp, Artificial Sequence
  Description of Artificial Sequence: Synthetic oligonucleotide
ggctggtccgagtgcagtggtgttta

SEQ ID NO: 2464 - DNA, 26 bp, Artificial Sequence
  Description of Artificial Sequence: Synthetic oligonucleotide
ggctggtccgagtgcagtggtgttta

SEQ ID NO: 2465 - DNA, 26 bp, Artificial Sequence
  Description of Artificial Sequence: Synthetic oligonucleotide
ggctggtccgagtgcagtggtgttta

SEQ ID NO: 2466 - DNA, 23 bp, Artificial Sequence
  Description of Artificial Sequence: Synthetic oligonucleotide
ggctggtccgatggtagtgggtt

SEQ ID NO: 2467 - DNA, 23 bp, Artificial Sequence
  Description of Artificial Sequence: Synthetic oligonucleotide
ggctggtccgatggtagtgggtt

SEQ ID NO: 2468 - DNA, 20 bp, Artificial Sequence
  Description of Artificial Sequence: Synthetic oligonucleotide
ccacgaggaagagaggtagc

SEQ ID NO: 2469 - DNA, 18 bp, Artificial Sequence
  Description of Artificial Sequence: Synthetic oligonucleotide
cggaagcgtgctgggccc

SEQ ID NO: 2470 - DNA, 18 bp, Artificial Sequence
  Description of Artificial Sequence: Synthetic oligonucleotide
cggaagcgtgctgggccc

SEQ ID NO: 2471 - DNA, 18 bp, Artificial Sequence
  Description of Artificial Sequence: Synthetic oligonucleotide
cggaagcgtgctgggccc

SEQ ID NO: 2472 - DNA, 18 bp, Artificial Sequence
  Description of Artificial Sequence: Synthetic oligonucleotide
cggaagcgtgctgggccc

SEQ ID NO: 2473 - DNA, 18 bp, Artificial Sequence
  Description of Artificial Sequence: Synthetic oligonucleotide
cggaagcgtgctgggccc

SEQ ID NO: 2474 - DNA, 23 bp, Artificial Sequence
  Description of Artificial Sequence: Synthetic oligonucleotide
ggagagaacgcggtctgagtggt

SEQ ID NO: 2475 - DNA, 23 bp, Artificial Sequence
  Description of Artificial Sequence: Synthetic oligonucleotide
ggagagaacgcggtctgagtggt

SEQ ID NO: 2476 - DNA, 23 bp, Artificial Sequence
  Description of Artificial Sequence: Synthetic oligonucleotide
ggagagaacgcggtctgagtggt

SEQ ID NO: 2477 - DNA, 23 bp, Artificial Sequence
  Description of Artificial Sequence: Synthetic oligonucleotide
ggagagaacgcggtctgagtggt

SEQ ID NO: 2478 - DNA, 23 bp, Artificial Sequence
  Description of Artificial Sequence: Synthetic oligonucleotide
ggagagaacgcggtctgagtggt

SEQ ID NO: 2479 - DNA, 19 bp, Artificial Sequence
  Description of Artificial Sequence: Synthetic oligonucleotide
atccccagcatctccacca

SEQ ID NO: 2480 - DNA, 25 bp, Artificial Sequence
  Description of Artificial Sequence: Synthetic oligonucleotide
ccccccactgctaaatttgactgga

SEQ ID NO: 2481 - DNA, 19 bp, Artificial Sequence
  Description of Artificial Sequence: Synthetic oligonucleotide
cagcatcagcagcatcatc

SEQ ID NO: 2482 - DNA, 22 bp, Artificial Sequence
  Description of Artificial Sequence: Synthetic oligonucleotide
tcaaaactgaggggcattttct

SEQ ID NO: 2483 - DNA, 18 bp, Artificial Sequence
  Description of Artificial Sequence: Synthetic oligonucleotide
cagggaggtgaatgtgat

SEQ ID NO: 2484 - DNA, 22 bp, Artificial Sequence
  Description of Artificial Sequence: Synthetic oligonucleotide
gaacaccaggagaaatcggtca

SEQ ID NO: 2485 - DNA, 24 bp, Artificial Sequence
  Description of Artificial Sequence: Synthetic oligonucleotide
ccagacagaattctatgcactttc

SEQ ID NO: 2486 - DNA, 23 bp, Artificial Sequence
  Description of Artificial Sequence: Synthetic oligonucleotide
cactgtgggccctctccgcacca

SEQ ID NO: 2487 - DNA, 22 bp, Artificial Sequence
  Description of Artificial Sequence: Synthetic oligonucleotide
ttatggcccttcggtaattcac

SEQ ID NO: 2488 - DNA, 22 bp, Artificial Sequence
  Description of Artificial Sequence: Synthetic oligonucleotide
tttttcattattgctcctgacc

SEQ ID NO: 2489 - DNA, 22 bp, Artificial Sequence
  Description of Artificial Sequence: Synthetic oligonucleotide
agttttgcatagttgcactaca

SEQ ID NO: 2490 - DNA, 22 bp, Artificial Sequence
  Description of Artificial Sequence: Synthetic oligonucleotide
agtaacaatcgaaagccacggt

SEQ ID NO: 2491 - DNA, 24 bp, Artificial Sequence
  Description of Artificial Sequence: Synthetic oligonucleotide
agtgtgagttctaccattgccaaa

SEQ ID NO: 2492 - DNA, 22 bp, Artificial Sequence
  Description of Artificial Sequence: Synthetic oligonucleotide
tggagtgtgacaatggtgtttg

SEQ ID NO: 2493 - DNA, 22 bp, Artificial Sequence
  Description of Artificial Sequence: Synthetic oligonucleotide
ccaatattactgtgctgcttta

SEQ ID NO: 2494 - DNA, 20 bp, Artificial Sequence
  Description of Artificial Sequence: Synthetic oligonucleotide
taaggcacgcggtgaatgcc

SEQ ID NO: 2495 - DNA, 20 bp, Artificial Sequence
  Description of Artificial Sequence: Synthetic oligonucleotide
ggcattcaccgcgtgcctta

SEQ ID NO: 2496 - DNA, 20 bp, Artificial Sequence
  Description of Artificial Sequence: Synthetic oligonucleotide
taaggcacgcggtgaatgcc

SEQ ID NO: 2497 - DNA, 22 bp, Artificial Sequence
  Description of Artificial Sequence: Synthetic oligonucleotide
tcgtaccgtgagtaataatgcg

SEQ ID NO: 2498 - DNA, 22 bp, Artificial Sequence
  Description of Artificial Sequence: Synthetic oligonucleotide
atggcaatatgttggcatagca

SEQ ID NO: 2499 - DNA, 21 bp, Artificial Sequence
  Description of Artificial Sequence: Synthetic oligonucleotide
tcacagtgaaccggtctcttt

SEQ ID NO: 2500 - DNA, 21 bp, Artificial Sequence
  Description of Artificial Sequence: Synthetic oligonucleotide
tcacagtgaaccggtctcttt

SEQ ID NO: 2501 - DNA, 23 bp, Artificial Sequence
  Description of Artificial Sequence: Synthetic oligonucleotide
tgtgcaaatctatgcaaaactga

SEQ ID NO: 2502 - DNA, 22 bp, Artificial Sequence
  Description of Artificial Sequence: Synthetic oligonucleotide
ctacaaagggaagcactttctc

SEQ ID NO: 2503 - DNA, 23 bp, Artificial Sequence
  Description of Artificial Sequence: Synthetic oligonucleotide
tcagttttgcatggatttgcaca

SEQ ID NO: 2504 - DNA, 23 bp, Artificial Sequence
  Description of Artificial Sequence: Synthetic oligonucleotide
tgtgcaaatccatgcaaaactga

SEQ ID NO: 2505 - DNA, 22 bp, Artificial Sequence
  Description of Artificial Sequence: Synthetic oligonucleotide
aagttctgttatacactcaggc

SEQ ID NO: 2506 - DNA, 21 bp, Artificial Sequence
  Description of Artificial Sequence: Synthetic oligonucleotide
ggtcagaacccatcattcact

SEQ ID NO: 2507 - DNA, 24 bp, Artificial Sequence
  Description of Artificial Sequence: Synthetic oligonucleotide
agcctggaagctggagcctgcagt

SEQ ID NO: 2508 - DNA, 21 bp, Artificial Sequence
  Description of Artificial Sequence: Synthetic oligonucleotide
gcagtccatgggcatatacac

SEQ ID NO: 2509 - DNA, 21 bp, Artificial Sequence
  Description of Artificial Sequence: Synthetic oligonucleotide
tgcaggctgatcttcttctct

SEQ ID NO: 2510 - DNA, 21 bp, Artificial Sequence
  Description of Artificial Sequence: Synthetic oligonucleotide
aaaggccacatccagcaccgt

SEQ ID NO: 2511 - DNA, 21 bp, Artificial Sequence
  Description of Artificial Sequence: Synthetic oligonucleotide
actctagctgccaaaggcgct

SEQ ID NO: 2512 - DNA, 21 bp, Artificial Sequence
  Description of Artificial Sequence: Synthetic oligonucleotide
agttaggattaggtcgtggaa

SEQ ID NO: 2513 - DNA, 21 bp, Artificial Sequence
  Description of Artificial Sequence: Synthetic oligonucleotide
ttccacgacctaatcctaact

SEQ ID NO: 2514 - DNA, 21 bp, Artificial Sequence
  Description of Artificial Sequence: Synthetic oligonucleotide
atatatgatgacttagctttt

SEQ ID NO: 2515 - DNA, 18 bp, Artificial Sequence
  Description of Artificial Sequence: Synthetic oligonucleotide
tcagctggccctcatttc

SEQ ID NO: 2516 - DNA, 22 bp, Artificial Sequence
  Description of Artificial Sequence: Synthetic oligonucleotide
aatcactaaccacacggccagg

SEQ ID NO: 2517 - DNA, 22 bp, Artificial Sequence
  Description of Artificial Sequence: Synthetic oligonucleotide
gctgccgtatatgtgatgtcac

SEQ ID NO: 2518 - DNA, 21 bp, Artificial Sequence
  Description of Artificial Sequence: Synthetic oligonucleotide
gaccaagaaatagcctttcaa

SEQ ID NO: 2519 - DNA, 22 bp, Artificial Sequence
  Description of Artificial Sequence: Synthetic oligonucleotide
gatgagctcattgtaatatgag

SEQ ID NO: 2520 - DNA, 22 bp, Artificial Sequence
  Description of Artificial Sequence: Synthetic oligonucleotide
tcaggctcagtcccctcccgat

SEQ ID NO: 2521 - DNA, 22 bp, Artificial Sequence
  Description of Artificial Sequence: Synthetic oligonucleotide
ctctagagggaagcgctttctg

SEQ ID NO: 2522 - DNA, 22 bp, Artificial Sequence
  Description of Artificial Sequence: Synthetic oligonucleotide
agctcccaagagcctaacccgt

SEQ ID NO: 2523 - DNA, 22 bp, Artificial Sequence
  Description of Artificial Sequence: Synthetic oligonucleotide
caacaaatcccagtctacctaa

SEQ ID NO: 2524 - DNA, 21 bp, Artificial Sequence
  Description of Artificial Sequence: Synthetic oligonucleotide
actttccaggattcattaact

SEQ ID NO: 2525 - DNA, 23 bp, Artificial Sequence
  Description of Artificial Sequence: Synthetic oligonucleotide
tgagtgtgtgtgtgtgagtgtgt

SEQ ID NO: 2526 - DNA, 21 bp, Artificial Sequence
  Description of Artificial Sequence: Synthetic oligonucleotide
aggggtgctatctgtgattga

SEQ ID NO: 2527 - DNA, 21 bp, Artificial Sequence
  Description of Artificial Sequence: Synthetic oligonucleotide
tggtagactatggaacgtagg

SEQ ID NO: 2528 - DNA, 21 bp, Artificial Sequence
  Description of Artificial Sequence: Synthetic oligonucleotide
aaagtgcttccttttagaggg

SEQ ID NO: 2529 - DNA, 21 bp, Artificial Sequence
  Description of Artificial Sequence: Synthetic oligonucleotide
aaagtgcttcctttttgaggg

SEQ ID NO: 2530 - DNA, 20 bp, Artificial Sequence
  Description of Artificial Sequence: Synthetic oligonucleotide
actcaaactgtgggggcact

SEQ ID NO: 2531 - DNA, 24 bp, Artificial Sequence
  Description of Artificial Sequence: Synthetic oligonucleotide
acaaagtgcttccctttagagtgt

SEQ ID NO: 2532 - DNA, 22 bp, Artificial Sequence
  Description of Artificial Sequence: Synthetic oligonucleotide
aagtgcttccttttagagggtt

SEQ ID NO: 2533 - DNA, 22 bp, Artificial Sequence
  Description of Artificial Sequence: Synthetic oligonucleotide
acaaagtgcttccctttagagt

SEQ ID NO: 2534 - DNA, 21 bp, Artificial Sequence
  Description of Artificial Sequence: Synthetic oligonucleotide
agaattgcgtttggacaatca

SEQ ID NO: 2535 - DNA, 21 bp, Artificial Sequence
  Description of Artificial Sequence: Synthetic oligonucleotide
tgattgtccaaacgcaattct

SEQ ID NO: 2536 - DNA, 22 bp, Artificial Sequence
  Description of Artificial Sequence: Synthetic oligonucleotide
cagtggttttaccctatggtag

SEQ ID NO: 2537 - DNA, 23 bp, Artificial Sequence
  Description of Artificial Sequence: Synthetic oligonucleotide
tgaggggcagagagcgagacttt

SEQ ID NO: 2538 - DNA, 22 bp, Artificial Sequence
  Description of Artificial Sequence: Synthetic oligonucleotide
gaagtaaacatccacctcccag

SEQ ID NO: 2539 - DNA, 21 bp, Artificial Sequence
  Description of Artificial Sequence: Synthetic oligonucleotide
gccaatatttctgtgctgcta

SEQ ID NO: 2540 - DNA, 22 bp, Artificial Sequence
  Description of Artificial Sequence: Synthetic oligonucleotide
tccacatggagttgctgttaca

SEQ ID NO: 2541 - DNA, 22 bp, Artificial Sequence
  Description of Artificial Sequence: Synthetic oligonucleotide
tccacatggagttgctgttaca

SEQ ID NO: 2542 - DNA, 22 bp, Artificial Sequence
  Description of Artificial Sequence: Synthetic oligonucleotide
ttcaccaccttctccacccagc

SEQ ID NO: 2543 - DNA, 23 bp, Artificial Sequence
  Description of Artificial Sequence: Synthetic oligonucleotide
cagctgcttttgggattccgttg

SEQ ID NO: 2544 - DNA, 22 bp, Artificial Sequence
  Description of Artificial Sequence: Synthetic oligonucleotide
tgatatgtttgatatattaggt

SEQ ID NO: 2545 - DNA, 21 bp, Artificial Sequence
  Description of Artificial Sequence: Synthetic oligonucleotide
ggctgtcaattcataggtcag

SEQ ID NO: 2546 - DNA, 22 bp, Artificial Sequence
  Description of Artificial Sequence: Synthetic oligonucleotide
accagctaacaatacactgcca

SEQ ID NO: 2547 - DNA, 23 bp, Artificial Sequence
  Description of Artificial Sequence: Synthetic oligonucleotide
cggctctgtcgtcgaggcgctca

SEQ ID NO: 2548 - DNA, 23 bp, Artificial Sequence
  Description of Artificial Sequence: Synthetic oligonucleotide
catgagtgacgccctctggagta

SEQ ID NO: 2549 - DNA, 22 bp, Artificial Sequence
  Description of Artificial Sequence: Synthetic oligonucleotide
gaaaagccagggtctgtataga

SEQ ID NO: 2550 - DNA, 24 bp, Artificial Sequence
  Description of Artificial Sequence: Synthetic oligonucleotide
aatccttggaacctaggtgtgagt

SEQ ID NO: 2551 - DNA, 22 bp, Artificial Sequence
  Description of Artificial Sequence: Synthetic oligonucleotide
acaggtgaggttcttgggagcc

SEQ ID NO: 2552 - DNA, 22 bp, Artificial Sequence
  Description of Artificial Sequence: Synthetic oligonucleotide
agggcagtatacttgctgattg

SEQ ID NO: 2553 - DNA, 23 bp, Artificial Sequence
  Description of Artificial Sequence: Synthetic oligonucleotide
gaagtgcttcgattttggggtgt

SEQ ID NO: 2554 - DNA, 22 bp, Artificial Sequence
  Description of Artificial Sequence: Synthetic oligonucleotide
aatgcacctgggcaaggattca

SEQ ID NO: 2555 - DNA, 22 bp, Artificial Sequence
  Description of Artificial Sequence: Synthetic oligonucleotide
taatactgcctggtaatgatga

SEQ ID NO: 2556 - DNA, 23 bp, Artificial Sequence
  Description of Artificial Sequence: Synthetic oligonucleotide
taatactgccgggtaatgatgga

SEQ ID NO: 2557 - DNA, 22 bp, Artificial Sequence
  Description of Artificial Sequence: Synthetic oligonucleotide
taacactgtctggtaacgatgt

SEQ ID NO: 2558 - DNA, 21 bp, Artificial Sequence
  Description of Artificial Sequence: Synthetic oligonucleotide
aatataacacagatggcctgt

SEQ ID NO: 2559 - DNA, 21 bp, Artificial Sequence
  Description of Artificial Sequence: Synthetic oligonucleotide
tagtagaccgtatagcgtacg

SEQ ID NO: 2560 - DNA, 23 bp, Artificial Sequence
  Description of Artificial Sequence: Synthetic oligonucleotide
acttcacctggtccactagccgt

SEQ ID NO: 2561 - DNA, 21 bp, Artificial Sequence
  Description of Artificial Sequence: Synthetic oligonucleotide
atcagaggttcagcttaccct

SEQ ID NO: 2562 - DNA, 21 bp, Artificial Sequence
  Description of Artificial Sequence: Synthetic oligonucleotide
gctagtcctgactcagccagt

SEQ ID NO: 2563 - DNA, 22 bp, Artificial Sequence
  Description of Artificial Sequence: Synthetic oligonucleotide
ttgtacatggtaggctttcatt

SEQ ID NO: 2564 - DNA, 23 bp, Artificial Sequence
  Description of Artificial Sequence: Synthetic oligonucleotide
agtgcctgagggagtaagagccc

SEQ ID NO: 2565 - DNA, 23 bp, Artificial Sequence
  Description of Artificial Sequence: Synthetic oligonucleotide
agtgcctgagggagtaagagccc

SEQ ID NO: 2566 - DNA, 21 bp, Artificial Sequence
  Description of Artificial Sequence: Synthetic oligonucleotide
aaaacggtgagattttgtttt

SEQ ID NO: 2567 - DNA, 22 bp, Artificial Sequence
  Description of Artificial Sequence: Synthetic oligonucleotide
tgggtctttgcgggcgagatga

SEQ ID NO: 2568 - DNA, 22 bp, Artificial Sequence
  Description of Artificial Sequence: Synthetic oligonucleotide
tgaattactttgtaaaccacca

SEQ ID NO: 2569 - DNA, 22 bp, Artificial Sequence
  Description of Artificial Sequence: Synthetic oligonucleotide
actccaacagggccgcgtctcc

SEQ ID NO: 2570 - DNA, 22 bp, Artificial Sequence
  Description of Artificial Sequence: Synthetic oligonucleotide
cttccagtcgaggatgtttaca

SEQ ID NO: 2571 - DNA, 22 bp, Artificial Sequence
  Description of Artificial Sequence: Synthetic oligonucleotide
agctgagtgtaggatgtttaca

SEQ ID NO: 2572 - DNA, 23 bp, Artificial Sequence
  Description of Artificial Sequence: Synthetic oligonucleotide
tgtaaacatcctacactctcagc

SEQ ID NO: 2573 - DNA, 23 bp, Artificial Sequence
  Description of Artificial Sequence: Synthetic oligonucleotide
gctgagagtgtaggatgtttaca

SEQ ID NO: 2574 - DNA, 22 bp, Artificial Sequence
  Description of Artificial Sequence: Synthetic oligonucleotide
cttccagtcggggatgtttaca

SEQ ID NO: 2575 - DNA, 22 bp, Artificial Sequence
  Description of Artificial Sequence: Synthetic oligonucleotide
tgtaaacatccttgactggaag

SEQ ID NO: 2576 - DNA, 22 bp, Artificial Sequence
  Description of Artificial Sequence: Synthetic oligonucleotide
aatgataatacaacctgctaag

SEQ ID NO: 2577 - DNA, 22 bp, Artificial Sequence
  Description of Artificial Sequence: Synthetic oligonucleotide
acaaaagcaactgaggttcttg

SEQ ID NO: 2578 - DNA, 24 bp, Artificial Sequence
  Description of Artificial Sequence: Synthetic oligonucleotide
ttctccaaaagaaagcactttctg

SEQ ID NO: 2579 - DNA, 24 bp, Artificial Sequence
  Description of Artificial Sequence: Synthetic oligonucleotide
ttctccaaaagaaagcactttctg

SEQ ID NO: 2580 - DNA, 22 bp, Artificial Sequence
  Description of Artificial Sequence: Synthetic oligonucleotide
taatactgtctggtaaaaccgt

SEQ ID NO: 2581 - DNA, 22 bp, Artificial Sequence
  Description of Artificial Sequence: Synthetic oligonucleotide
tcctgtactgagctgccccgag

SEQ ID NO: 2582 - DNA, 22 bp, Artificial Sequence
  Description of Artificial Sequence: Synthetic oligonucleotide
ctcggggcagctcagtacagga

SEQ ID NO: 2583 - DNA, 21 bp, Artificial Sequence
  Description of Artificial Sequence: Synthetic oligonucleotide
tgttcatgtagatgtttaagc

SEQ ID NO: 2584 - DNA, 22 bp, Artificial Sequence
  Description of Artificial Sequence: Synthetic oligonucleotide
aacccgtagatccgatcttgtg

SEQ ID NO: 2585 - DNA, 21 bp, Artificial Sequence
  Description of Artificial Sequence: Synthetic oligonucleotide
ctcccacatgcagggtttgca

SEQ ID NO: 2586 - DNA, 22 bp, Artificial Sequence
  Description of Artificial Sequence: Synthetic oligonucleotide
cacccgtagaaccgaccttgcg

SEQ ID NO: 2587 - DNA, 22 bp, Artificial Sequence
  Description of Artificial Sequence: Synthetic oligonucleotide
tatacaagggcagactctctct

SEQ ID NO: 2588 - DNA, 22 bp, Artificial Sequence
  Description of Artificial Sequence: Synthetic oligonucleotide
aactggccctcaaagtcccgct

SEQ ID NO: 2589 - DNA, 21 bp, Artificial Sequence
  Description of Artificial Sequence: Synthetic oligonucleotide
gagctgcatcctggctccggg

SEQ ID NO: 2590 - DNA, 22 bp, Artificial Sequence
  Description of Artificial Sequence: Synthetic oligonucleotide
ctgggagagggttgtttactcc

SEQ ID NO: 2591 - DNA, 22 bp, Artificial Sequence
  Description of Artificial Sequence: Synthetic oligonucleotide
tgaaatgcaaacctgcaaaact

SEQ ID NO: 2592 - DNA, 21 bp, Artificial Sequence
  Description of Artificial Sequence: Synthetic oligonucleotide
agggctcatcttggtcctgca

SEQ ID NO: 2593 - DNA, 21 bp, Artificial Sequence
  Description of Artificial Sequence: Synthetic oligonucleotide
gcaaggcagtggcctgtacag

SEQ ID NO: 2594 - DNA, 23 bp, Artificial Sequence
  Description of Artificial Sequence: Synthetic oligonucleotide
aaatcagaatcacacctggggga

SEQ ID NO: 2595 - DNA, 20 bp, Artificial Sequence
  Description of Artificial Sequence: Synthetic oligonucleotide
ctgcaaagggaagccctttc

SEQ ID NO: 2596 - DNA, 20 bp, Artificial Sequence
  Description of Artificial Sequence: Synthetic oligonucleotide
ctgcaaagggaagccctttc

SEQ ID NO: 2597 - DNA, 19 bp, Artificial Sequence
  Description of Artificial Sequence: Synthetic oligonucleotide
gtcctgaattccgcagcct

SEQ ID NO: 2598 - DNA, 22 bp, Artificial Sequence
  Description of Artificial Sequence: Synthetic oligonucleotide
agaggctggccgtgatgaattc

SEQ ID NO: 2599 - DNA, 22 bp, Artificial Sequence
  Description of Artificial Sequence: Synthetic oligonucleotide
cacttacttctttgcagatgag

SEQ ID NO: 2600 - DNA, 22 bp, Artificial Sequence
  Description of Artificial Sequence: Synthetic oligonucleotide
tattcaggaacatattgcaaaa

SEQ ID NO: 2601 - DNA, 22 bp, Artificial Sequence
  Description of Artificial Sequence: Synthetic oligonucleotide
aggaaaccagcaagtgttgacg

SEQ ID NO: 2602 - DNA, 22 bp, Artificial Sequence
  Description of Artificial Sequence: Synthetic oligonucleotide
tggtttaccgtcccacatacat

SEQ ID NO: 2603 - DNA, 22 bp, Artificial Sequence
  Description of Artificial Sequence: Synthetic oligonucleotide
accactgaccgttgactgtacc

SEQ ID NO: 2604 - DNA, 22 bp, Artificial Sequence
  Description of Artificial Sequence: Synthetic oligonucleotide
ctaagccaccatgtgaaaccag

SEQ ID NO: 2605 - DNA, 21 bp, Artificial Sequence
  Description of Artificial Sequence: Synthetic oligonucleotide
cacattacacggtcgacctct

SEQ ID NO: 2606 - DNA, 22 bp, Artificial Sequence
  Description of Artificial Sequence: Synthetic oligonucleotide
agctagtgagaagtcaatgcct

SEQ ID NO: 2607 - DNA, 22 bp, Artificial Sequence
  Description of Artificial Sequence: Synthetic oligonucleotide
cttacagtatatgatgatatcc

SEQ ID NO: 2608 - DNA, 17 bp, Artificial Sequence
  Description of Artificial Sequence: Synthetic oligonucleotide
tcccaccgctgccaccc

SEQ ID NO: 2609 - DNA, 22 bp, Artificial Sequence
  Description of Artificial Sequence: Synthetic oligonucleotide
tatgtaacatggtccactaact

SEQ ID NO: 2610 - DNA, 22 bp, Artificial Sequence
  Description of Artificial Sequence: Synthetic oligonucleotide
agaaggaaattgaattcattta

SEQ ID NO: 2611 - DNA, 23 bp, Artificial Sequence
  Description of Artificial Sequence: Synthetic oligonucleotide
acaccaatgccctaggggatgcg

SEQ ID NO: 2612 - DNA, 18 bp, Artificial Sequence
  Description of Artificial Sequence: Synthetic oligonucleotide
tgcttcctttcagagggt

SEQ ID NO: 2613 - DNA, 18 bp, Artificial Sequence
  Description of Artificial Sequence: Synthetic oligonucleotide
tgcttcctttcagagggt

SEQ ID NO: 2614 - DNA, 23 bp, Artificial Sequence
  Description of Artificial Sequence: Synthetic oligonucleotide
ctaactgcactagatgcacctta

SEQ ID NO: 2615 - DNA, 23 bp, Artificial Sequence
  Description of Artificial Sequence: Synthetic oligonucleotide
caaagtgcttacagtgcaggtag

SEQ ID NO: 2616 - DNA, 22 bp, Artificial Sequence
  Description of Artificial Sequence: Synthetic oligonucleotide
tagcagcacgtaaatattggcg

SEQ ID NO: 2617 - DNA, 22 bp, Artificial Sequence
  Description of Artificial Sequence: Synthetic oligonucleotide
cgccaatatttacgtgctgcta

SEQ ID NO: 2618 - DNA, 22 bp, Artificial Sequence
  Description of Artificial Sequence: Synthetic oligonucleotide
cctgttctccattacttggctc

SEQ ID NO: 2619 - DNA, 23 bp, Artificial Sequence
  Description of Artificial Sequence: Synthetic oligonucleotide
actcagaaggacaagtagagttt

SEQ ID NO: 2620 - DNA, 21 bp, Artificial Sequence
  Description of Artificial Sequence: Synthetic oligonucleotide
gcccctgggcctatcctagaa

SEQ ID NO: 2621 - DNA, 23 bp, Artificial Sequence
  Description of Artificial Sequence: Synthetic oligonucleotide
taaatcccatggtgccttctcct

SEQ ID NO: 2622 - DNA, 21 bp, Artificial Sequence
  Description of Artificial Sequence: Synthetic oligonucleotide
atcatagaggaaaatccacgt

SEQ ID NO: 2623 - DNA, 21 bp, Artificial Sequence
  Description of Artificial Sequence: Synthetic oligonucleotide
atcatagaggaaaatccacgt

SEQ ID NO: 2624 - DNA, 22 bp, Artificial Sequence
  Description of Artificial Sequence: Synthetic oligonucleotide
atcatagaggaaaatccatgtt

SEQ ID NO: 2625 - DNA, 21 bp, Artificial Sequence
  Description of Artificial Sequence: Synthetic oligonucleotide
aacatagaggaaattccacgt

SEQ ID NO: 2626 - DNA, 22 bp, Artificial Sequence
  Description of Artificial Sequence: Synthetic oligonucleotide
ctcctccaacaatcctagacca

SEQ ID NO: 2627 - DNA, 23 bp, Artificial Sequence
  Description of Artificial Sequence: Synthetic oligonucleotide
gagcaaggctcttgtctgtaagt

SEQ ID NO: 2628 - DNA, 22 bp, Artificial Sequence
  Description of Artificial Sequence: Synthetic oligonucleotide
cacacactgcaattacttttgc

SEQ ID NO: 2629 - DNA, 23 bp, Artificial Sequence
  Description of Artificial Sequence: Synthetic oligonucleotide
gacacgggcgacagctgcggccc

SEQ ID NO: 2630 - DNA, 20 bp, Artificial Sequence
  Description of Artificial Sequence: Synthetic oligonucleotide
agagatgagagaaacaccct

SEQ ID NO: 2631 - DNA, 25 bp, Artificial Sequence
  Description of Artificial Sequence: Synthetic oligonucleotide
aggggtggtgttgggacagctccgt

SEQ ID NO: 2632 - DNA, 22 bp, Artificial Sequence
  Description of Artificial Sequence: Synthetic oligonucleotide
gaaatcaagcgtgggtgagacc

SEQ ID NO: 2633 - DNA, 22 bp, Artificial Sequence
  Description of Artificial Sequence: Synthetic oligonucleotide
attctgcatttttagcaagttc

SEQ ID NO: 2634 - DNA, 24 bp, Artificial Sequence
  Description of Artificial Sequence: Synthetic oligonucleotide
atccaatcattttccctagccagt

SEQ ID NO: 2635 - DNA, 23 bp, Artificial Sequence
  Description of Artificial Sequence: Synthetic oligonucleotide
aggttacccgagcaactttgcat

SEQ ID NO: 2636 - DNA, 22 bp, Artificial Sequence
  Description of Artificial Sequence: Synthetic oligonucleotide
catcatcgtctcaaatgagtct

SEQ ID NO: 2637 - DNA, 20 bp, Artificial Sequence
  Description of Artificial Sequence: Synthetic oligonucleotide
aagcagaaaaaggcaaacga

SEQ ID NO: 2638 - DNA, 22 bp, Artificial Sequence
  Description of Artificial Sequence: Synthetic oligonucleotide
ctctagagggaagcgctttctg

SEQ ID NO: 2639 - DNA, 20 bp, Artificial Sequence
  Description of Artificial Sequence: Synthetic oligonucleotide
tcactgttcagacaggcgga

SEQ ID NO: 2640 - DNA, 20 bp, Artificial Sequence
  Description of Artificial Sequence: Synthetic oligonucleotide
tctgcagggtttgctttgag

SEQ ID NO: 2641 - DNA, 22 bp, Artificial Sequence
  Description of Artificial Sequence: Synthetic oligonucleotide
cctcaggcacggccgggccacc

SEQ ID NO: 2642 - DNA, 24 bp, Artificial Sequence
  Description of Artificial Sequence: Synthetic oligonucleotide
tcagagcatgtgtttaatcaggct

SEQ ID NO: 2643 - DNA, 22 bp, Artificial Sequence
  Description of Artificial Sequence: Synthetic oligonucleotide
gaggctcagaatggctcaggag

SEQ ID NO: 2644 - DNA, 22 bp, Artificial Sequence
  Description of Artificial Sequence: Synthetic oligonucleotide
cactcagcaccaggatattgtt

SEQ ID NO: 2645 - DNA, 21 bp, Artificial Sequence
  Description of Artificial Sequence: Synthetic oligonucleotide
gtgccagctgcagtgggggag

SEQ ID NO: 2646 - DNA, 22 bp, Artificial Sequence
  Description of Artificial Sequence: Synthetic oligonucleotide
aatcctttgtccctgggtgaga

SEQ ID NO: 2647 - DNA, 22 bp, Artificial Sequence
  Description of Artificial Sequence: Synthetic oligonucleotide
ctctagagggaagcgctttctg

SEQ ID NO: 2648 - DNA, 22 bp, Artificial Sequence
  Description of Artificial Sequence: Synthetic oligonucleotide
agcatcagcactgtgataactg

SEQ ID NO: 2649 - DNA, 21 bp, Artificial Sequence
  Description of Artificial Sequence: Synthetic oligonucleotide
gtgtcttttgctctgcagtca

SEQ ID NO: 2650 - DNA, 21 bp, Artificial Sequence
  Description of Artificial Sequence: Synthetic oligonucleotide
gtgtcttttgctctgcagtca

SEQ ID NO: 2651 - DNA, 22 bp, Artificial Sequence
  Description of Artificial Sequence: Synthetic oligonucleotide
gtgattgccactctcctgagta

SEQ ID NO: 2652 - DNA, 21 bp, Artificial Sequence
  Description of Artificial Sequence: Synthetic oligonucleotide
ctatacaatctactgtctttc

SEQ ID NO: 2653 - DNA, 21 bp, Artificial Sequence
  Description of Artificial Sequence: Synthetic oligonucleotide
ctatacaatctactgtctttc

SEQ ID NO: 2654 - DNA, 21 bp, Artificial Sequence
  Description of Artificial Sequence: Synthetic oligonucleotide
tctactcacagaagtgtcaat

SEQ ID NO: 2655 - DNA, 21 bp, Artificial Sequence
  Description of Artificial Sequence: Synthetic oligonucleotide
tctactcacagaagtgtcaat

SEQ ID NO: 2656 - DNA, 21 bp, Artificial Sequence
  Description of Artificial Sequence: Synthetic oligonucleotide
tctactcacagaagtgtcaat

SEQ ID NO: 2657 - DNA, 21 bp, Artificial Sequence
  Description of Artificial Sequence: Synthetic oligonucleotide
gaaggcgcttccctttggagt

SEQ ID NO: 2658 - DNA, 22 bp, Artificial Sequence
  Description of Artificial Sequence: Synthetic oligonucleotide
agtggggaacccttccatgagg

SEQ ID NO: 2659 - DNA, 22 bp, Artificial Sequence
  Description of Artificial Sequence: Synthetic oligonucleotide
gccagaaggggcatttagggca

SEQ ID NO: 2660 - DNA, 22 bp, Artificial Sequence
  Description of Artificial Sequence: Synthetic oligonucleotide
tatgtaacacggtccactaacc

SEQ ID NO: 2661 - DNA, 22 bp, Artificial Sequence
  Description of Artificial Sequence: Synthetic oligonucleotide
gcaaaagaaactgtggtttttg

SEQ ID NO: 2662 - DNA, 22 bp, Artificial Sequence
  Description of Artificial Sequence: Synthetic oligonucleotide
gcaaaagaaactgtggtttttg

SEQ ID NO: 2663 - DNA, 22 bp, Artificial Sequence
  Description of Artificial Sequence: Synthetic oligonucleotide
caacctggaggactccatgctg

SEQ ID NO: 2664 - DNA, 22 bp, Artificial Sequence
  Description of Artificial Sequence: Synthetic oligonucleotide
aagatgtggaaaaattggaatc

SEQ ID NO: 2665 - DNA, 22 bp, Artificial Sequence
  Description of Artificial Sequence: Synthetic oligonucleotide
acaaccagctaagacactgcca

SEQ ID NO: 2666 - DNA, 22 bp, Artificial Sequence
  Description of Artificial Sequence: Synthetic oligonucleotide
caatcactaactccactgccat

SEQ ID NO: 2667 - DNA, 22 bp, Artificial Sequence
  Description of Artificial Sequence: Synthetic oligonucleotide
tggtgggccgcagaacatgtgc

SEQ ID NO: 2668 - DNA, 22 bp, Artificial Sequence
  Description of Artificial Sequence: Synthetic oligonucleotide
tcacagttgccagctgagatta

SEQ ID NO: 2669 - DNA, 22 bp, Artificial Sequence
  Description of Artificial Sequence: Synthetic oligonucleotide
tcacatttgcctgcagagattt

SEQ ID NO: 2670 - DNA, 21 bp, Artificial Sequence
  Description of Artificial Sequence: Synthetic oligonucleotide
taattttatgtataagctagt

SEQ ID NO: 2671 - DNA, 24 bp, Artificial Sequence
  Description of Artificial Sequence: Synthetic oligonucleotide
cacccccagagcctcagctcccca

SEQ ID NO: 2672 - DNA, 22 bp, Artificial Sequence
  Description of Artificial Sequence: Synthetic oligonucleotide
actgggttcacctttaagggca

SEQ ID NO: 2673 - DNA, 23 bp, Artificial Sequence
  Description of Artificial Sequence: Synthetic oligonucleotide
aggcagtgtagttagctgattgc

SEQ ID NO: 2674 - DNA, 22 bp, Artificial Sequence
  Description of Artificial Sequence: Synthetic oligonucleotide
tgaggcagcacaatatggcctg

SEQ ID NO: 2675 - DNA, 22 bp, Artificial Sequence
  Description of Artificial Sequence: Synthetic oligonucleotide
gggagaggtctccctgcgcaca

SEQ ID NO: 2676 - DNA, 22 bp, Artificial Sequence
  Description of Artificial Sequence: Synthetic oligonucleotide
aacatcacagcaagtctgtgct

SEQ ID NO: 2677 - DNA, 22 bp, Artificial Sequence
  Description of Artificial Sequence: Synthetic oligonucleotide
ggcagagagtcagagcgcggat

SEQ ID NO: 2678 - DNA, 22 bp, Artificial Sequence
  Description of Artificial Sequence: Synthetic oligonucleotide
ctgcgattcctccctctactgt

SEQ ID NO: 2679 - DNA, 23 bp, Artificial Sequence
  Description of Artificial Sequence: Synthetic oligonucleotide
ccagttaccgcttccgctaccgc

SEQ ID NO: 2680 - DNA, 22 bp, Artificial Sequence
  Description of Artificial Sequence: Synthetic oligonucleotide
tatgtctgctgaccatcacctt

SEQ ID NO: 2681 - DNA, 22 bp, Artificial Sequence
  Description of Artificial Sequence: Synthetic oligonucleotide
cgggaagtgctagctcagcagt

SEQ ID NO: 2682 - DNA, 22 bp, Artificial Sequence
  Description of Artificial Sequence: Synthetic oligonucleotide
atctggaggtaagaagcacttt

SEQ ID NO: 2683 - DNA, 22 bp, Artificial Sequence
  Description of Artificial Sequence: Synthetic oligonucleotide
atctggaggtaagaagcacttt

SEQ ID NO: 2684 - DNA, 21 bp, Artificial Sequence
  Description of Artificial Sequence: Synthetic oligonucleotide
tggaaaccaagagtgggtcgc

SEQ ID NO: 2685 - DNA, 21 bp, Artificial Sequence
  Description of Artificial Sequence: Synthetic oligonucleotide
gcgacccatacttggtttcag

SEQ ID NO: 2686 - DNA, 22 bp, Artificial Sequence
  Description of Artificial Sequence: Synthetic oligonucleotide
gctgactcctagtccagggctc

SEQ ID NO: 2687 - DNA, 23 bp, Artificial Sequence
  Description of Artificial Sequence: Synthetic oligonucleotide
agaggcaggcatgcgggcagaca

SEQ ID NO: 2688 - DNA, 22 bp, Artificial Sequence
  Description of Artificial Sequence: Synthetic oligonucleotide
aatcagtctcattgctttataa

SEQ ID NO: 2689 - DNA, 23 bp, Artificial Sequence
  Description of Artificial Sequence: Synthetic oligonucleotide
ctacctgcactgtaagcactttt

SEQ ID NO: 2690 - DNA, 22 bp, Artificial Sequence
  Description of Artificial Sequence: Synthetic oligonucleotide
tgggttcctggcatgctgattt

SEQ ID NO: 2691 - DNA, 21 bp, Artificial Sequence
  Description of Artificial Sequence: Synthetic oligonucleotide
atctgcactgtcagcacttta

SEQ ID NO: 2692 - DNA, 22 bp, Artificial Sequence
  Description of Artificial Sequence: Synthetic oligonucleotide
cagataacagcagccccactgg

SEQ ID NO: 2693 - DNA, 22 bp, Artificial Sequence
  Description of Artificial Sequence: Synthetic oligonucleotide
ctctagagggaagcgctttctg

SEQ ID NO: 2694 - DNA, 22 bp, Artificial Sequence
  Description of Artificial Sequence: Synthetic oligonucleotide
aagtgcctccttttagagtgtt

SEQ ID NO: 2695 - DNA, 22 bp, Artificial Sequence
  Description of Artificial Sequence: Synthetic oligonucleotide
caaagtgcctccctttagagtg

SEQ ID NO: 2696 - DNA, 23 bp, Artificial Sequence
  Description of Artificial Sequence: Synthetic oligonucleotide
ctgggatctccggggtcttggtt

SEQ ID NO: 2697 - DNA, 22 bp, Artificial Sequence
  Description of Artificial Sequence: Synthetic oligonucleotide
aaagtgcatccttttagagtgt

SEQ ID NO: 2698 - DNA, 22 bp, Artificial Sequence
  Description of Artificial Sequence: Synthetic oligonucleotide
aaagtgcatccttttagagtgt

SEQ ID NO: 2699 - DNA, 21 bp, Artificial Sequence
  Description of Artificial Sequence: Synthetic oligonucleotide
ctggaggacggcaacagtcag

SEQ ID NO: 2700 - DNA, 21 bp, Artificial Sequence
  Description of Artificial Sequence: Synthetic oligonucleotide
aaggcagggcccccgctcccc

SEQ ID NO: 2701 - DNA, 23 bp, Artificial Sequence
  Description of Artificial Sequence: Synthetic oligonucleotide
cacccggctgtgtgcacatgtgc

SEQ ID NO: 2702 - DNA, 23 bp, Artificial Sequence
  Description of Artificial Sequence: Synthetic oligonucleotide
cacccggctgtgtgcacatgtgc

SEQ ID NO: 2703 - DNA, 23 bp, Artificial Sequence
  Description of Artificial Sequence: Synthetic oligonucleotide
cacccggctgtgtgcacatgtgc

SEQ ID NO: 2704 - DNA, 23 bp, Artificial Sequence
  Description of Artificial Sequence: Synthetic oligonucleotide
agctcggtctgaggcccctcagt

SEQ ID NO: 2705 - DNA, 22 bp, Artificial Sequence
  Description of Artificial Sequence: Synthetic oligonucleotide
gtgaaatgtttaggaccactag

SEQ ID NO: 2706 - DNA, 20 bp, Artificial Sequence
  Description of Artificial Sequence: Synthetic oligonucleotide
ttcccatgccctatacctct

SEQ ID NO: 2707 - DNA, 22 bp, Artificial Sequence
  Description of Artificial Sequence: Synthetic oligonucleotide
tccttcattccaccggagtctg

SEQ ID NO: 2708 - DNA, 22 bp, Artificial Sequence
  Description of Artificial Sequence: Synthetic oligonucleotide
aggcataggatgacaaagggaa

SEQ ID NO: 2709 - DNA, 22 bp, Artificial Sequence
  Description of Artificial Sequence: Synthetic oligonucleotide
ctctagagggaagcactttctg

SEQ ID NO: 2710 - DNA, 22 bp, Artificial Sequence
  Description of Artificial Sequence: Synthetic oligonucleotide
ctctagagggaagcactttctg

SEQ ID NO: 2711 - DNA, 22 bp, Artificial Sequence
  Description of Artificial Sequence: Synthetic oligonucleotide
cactagattgtgagctcctgga

SEQ ID NO: 2712 - DNA, 23 bp, Artificial Sequence
  Description of Artificial Sequence: Synthetic oligonucleotide
agcaagtacatccacgtttaagt

SEQ ID NO: 2713 - DNA, 22 bp, Artificial Sequence
  Description of Artificial Sequence: Synthetic oligonucleotide
caaaaatctcaattacttttgc

SEQ ID NO: 2714 - DNA, 21 bp, Artificial Sequence
  Description of Artificial Sequence: Synthetic oligonucleotide
atagcagcgcctcacgttttg

SEQ ID NO: 2715 - DNA, 23 bp, Artificial Sequence
  Description of Artificial Sequence: Synthetic oligonucleotide
ccgcttgagctaactccgacccg

SEQ ID NO: 2716 - DNA, 21 bp, Artificial Sequence
  Description of Artificial Sequence: Synthetic oligonucleotide
tcctcttctccctcctcccag

SEQ ID NO: 2717 - DNA, 23 bp, Artificial Sequence
  Description of Artificial Sequence: Synthetic oligonucleotide
aacactgatttcaaatggtgcta

SEQ ID NO: 2718 - DNA, 23 bp, Artificial Sequence
  Description of Artificial Sequence: Synthetic oligonucleotide
aacactgatttcaaatggtgcta

SEQ ID NO: 2719 - DNA, 22 bp, Artificial Sequence
  Description of Artificial Sequence: Synthetic oligonucleotide
taaccgatttcaaatggtgcta

SEQ ID NO: 2720 - DNA, 22 bp, Artificial Sequence
  Description of Artificial Sequence: Synthetic oligonucleotide
taaccgatttcagatggtgcta

SEQ ID NO: 2721 - DNA, 23 bp, Artificial Sequence
  Description of Artificial Sequence: Synthetic oligonucleotide
taaagtgcttatagtgcaggtag

SEQ ID NO: 2722 - DNA, 21 bp, Artificial Sequence
  Description of Artificial Sequence: Synthetic oligonucleotide
atgatccaggaacctgcctct

SEQ ID NO: 2723 - DNA, 21 bp, Artificial Sequence
  Description of Artificial Sequence: Synthetic oligonucleotide
ctttttgcggtctgggcttgc

SEQ ID NO: 2724 - DNA, 21 bp, Artificial Sequence
  Description of Artificial Sequence: Synthetic oligonucleotide
ctttttgcggtctgggcttgc

SEQ ID NO: 2725 - DNA, 23 bp, Artificial Sequence
  Description of Artificial Sequence: Synthetic oligonucleotide
ctacctgcactatgagcactttg

SEQ ID NO: 2726 - DNA, 19 bp, Artificial Sequence
  Description of Artificial Sequence: Synthetic oligonucleotide
tctaggctggtactgctga

SEQ ID NO: 2727 - DNA, 19 bp, Artificial Sequence
  Description of Artificial Sequence: Synthetic oligonucleotide
agtgtggctttcttagagc

SEQ ID NO: 2728 - DNA, 21 bp, Artificial Sequence
  Description of Artificial Sequence: Synthetic oligonucleotide
gaaggaagtgagtgcagccac

SEQ ID NO: 2729 - DNA, 19 bp, Artificial Sequence
  Description of Artificial Sequence: Synthetic oligonucleotide
aagcagctgcctctgaggc

SEQ ID NO: 2730 - DNA, 22 bp, Artificial Sequence
  Description of Artificial Sequence: Synthetic oligonucleotide
gactcttgaacaacacaggttt

SEQ ID NO: 2731 - DNA, 19 bp, Artificial Sequence
  Description of Artificial Sequence: Synthetic oligonucleotide
accagtgccctgcacactt

SEQ ID NO: 2732 - DNA, 20 bp, Artificial Sequence
  Description of Artificial Sequence: Synthetic oligonucleotide
cggctctgggtctgtgggga

SEQ ID NO: 2733 - DNA, 22 bp, Artificial Sequence
  Description of Artificial Sequence: Synthetic oligonucleotide
gctgaggctgtggggctggagt

SEQ ID NO: 2734 - DNA, 21 bp, Artificial Sequence
  Description of Artificial Sequence: Synthetic oligonucleotide
catcaccttccttctcctcca

SEQ ID NO: 2735 - DNA, 21 bp, Artificial Sequence
  Description of Artificial Sequence: Synthetic oligonucleotide
tcgactgccactcttactaga

SEQ ID NO: 2736 - DNA, 21 bp, Artificial Sequence
  Description of Artificial Sequence: Synthetic oligonucleotide
gaacggcttcatacaggagtt

SEQ ID NO: 2737 - DNA, 22 bp, Artificial Sequence
  Description of Artificial Sequence: Synthetic oligonucleotide
actcaaaatgggggcgctttcc

SEQ ID NO: 2738 - DNA, 22 bp, Artificial Sequence
  Description of Artificial Sequence: Synthetic oligonucleotide
agatcgaccgtgttatattcgc

SEQ ID NO: 2739 - DNA, 22 bp, Artificial Sequence
  Description of Artificial Sequence: Synthetic oligonucleotide
aggtctcactttgttgcccaga

SEQ ID NO: 2740 - DNA, 22 bp, Artificial Sequence
  Description of Artificial Sequence: Synthetic oligonucleotide
aggtctcactttgttgcccaga

SEQ ID NO: 2741 - DNA, 22 bp, Artificial Sequence
  Description of Artificial Sequence: Synthetic oligonucleotide
aggatctacactggctactgag

SEQ ID NO: 2742 - DNA, 24 bp, Artificial Sequence
  Description of Artificial Sequence: Synthetic oligonucleotide
tgggagaacctccctgcttctgct

SEQ ID NO: 2743 - DNA, 22 bp, Artificial Sequence
  Description of Artificial Sequence: Synthetic oligonucleotide
tggaatgtaaggaagtgtgtgg

SEQ ID NO: 2744 - DNA, 21 bp, Artificial Sequence
  Description of Artificial Sequence: Synthetic oligonucleotide
catgcacatgcacacatacat

SEQ ID NO: 2745 - DNA, 24 bp, Artificial Sequence
  Description of Artificial Sequence: Synthetic oligonucleotide
tctgggaaccggcatttgttctga

SEQ ID NO: 2746 - DNA, 22 bp, Artificial Sequence
  Description of Artificial Sequence: Synthetic oligonucleotide
cgtgttcacagcggaccttgat

SEQ ID NO: 2747 - DNA, 22 bp, Artificial Sequence
  Description of Artificial Sequence: Synthetic oligonucleotide
atcaaggtccgctgtgaacacg

SEQ ID NO: 2748 - DNA, 22 bp, Artificial Sequence
  Description of Artificial Sequence: Synthetic oligonucleotide
cgtgttcacagcggaccttgat

SEQ ID NO: 2749 - DNA, 22 bp, Artificial Sequence
  Description of Artificial Sequence: Synthetic oligonucleotide
aggggctggctttcctctggtc

SEQ ID NO: 2750 - DNA, 21 bp, Artificial Sequence
  Description of Artificial Sequence: Synthetic oligonucleotide
cggggcagctcagtacaggat

SEQ ID NO: 2751 - DNA, 21 bp, Artificial Sequence
  Description of Artificial Sequence: Synthetic oligonucleotide
atcctgtactgagctgccccg

SEQ ID NO: 2752 - DNA, 22 bp, Artificial Sequence
  Description of Artificial Sequence: Synthetic oligonucleotide
aactggatcaattataggagtg

SEQ ID NO: 2753 - DNA, 22 bp, Artificial Sequence
  Description of Artificial Sequence: Synthetic oligonucleotide
aagtcactgaagggttttgagt

SEQ ID NO: 2754 - DNA, 21 bp, Artificial Sequence
  Description of Artificial Sequence: Synthetic oligonucleotide
aagtgatctaaaggcctacat

SEQ ID NO: 2755 - DNA, 26 bp, Artificial Sequence
  Description of Artificial Sequence: Synthetic oligonucleotide
aagtagttggtttgtatgagatggtt

SEQ ID NO: 2756 - DNA, 26 bp, Artificial Sequence
  Description of Artificial Sequence: Synthetic oligonucleotide
aaccatctcatacaaaccaactactt

SEQ ID NO: 2757 - DNA, 26 bp, Artificial Sequence
  Description of Artificial Sequence: Synthetic oligonucleotide
aagtagttggtttgtatgagatggtt

SEQ ID NO: 2758 - DNA, 26 bp, Artificial Sequence
  Description of Artificial Sequence: Synthetic oligonucleotide
aagtagttggtttgtatgagatggtt

SEQ ID NO: 2759 - DNA, 22 bp, Artificial Sequence
  Description of Artificial Sequence: Synthetic oligonucleotide
tccggggacgaacgggacgggt

SEQ ID NO: 2760 - DNA, 19 bp, Artificial Sequence
  Description of Artificial Sequence: Synthetic oligonucleotide
cctgctccaaaaatccatt

SEQ ID NO: 2761 - DNA, 22 bp, Artificial Sequence
  Description of Artificial Sequence: Synthetic oligonucleotide
tgaagaagggggggaagggcgt

SEQ ID NO: 2762 - DNA, 22 bp, Artificial Sequence
  Description of Artificial Sequence: Synthetic oligonucleotide
cttatgcaagattcccttctac

SEQ ID NO: 2763 - DNA, 22 bp, Artificial Sequence
  Description of Artificial Sequence: Synthetic oligonucleotide
agtcggagtgtctcagaacttt

SEQ ID NO: 2764 - DNA, 22 bp, Artificial Sequence
  Description of Artificial Sequence: Synthetic oligonucleotide
agggacgggacgcggtgcagtg

SEQ ID NO: 2765 - DNA, 22 bp, Artificial Sequence
  Description of Artificial Sequence: Synthetic oligonucleotide
gcaaaagtaactgcagttttgg

SEQ ID NO: 2766 - DNA, 22 bp, Artificial Sequence
  Description of Artificial Sequence: Synthetic oligonucleotide
tcaatgactcaggtaagttgca

SEQ ID NO: 2767 - DNA, 21 bp, Artificial Sequence
  Description of Artificial Sequence: Synthetic oligonucleotide
caaaaaccacaaatacctttg

SEQ ID NO: 2768 - DNA, 22 bp, Artificial Sequence
  Description of Artificial Sequence: Synthetic oligonucleotide
gacaaaacccgcaaatactttt

SEQ ID NO: 2769 - DNA, 22 bp, Artificial Sequence
  Description of Artificial Sequence: Synthetic oligonucleotide
aaaagtacttgcggattttgct

SEQ ID NO: 2770 - DNA, 22 bp, Artificial Sequence
  Description of Artificial Sequence: Synthetic oligonucleotide
tctacaaaggaaagcgctttct

SEQ ID NO: 2771 - DNA, 22 bp, Artificial Sequence
  Description of Artificial Sequence: Synthetic oligonucleotide
tctacaaaggaaagcgctttct

SEQ ID NO: 2772 - DNA, 22 bp, Artificial Sequence
  Description of Artificial Sequence: Synthetic oligonucleotide
ggcaaaatccgcaattactttt

SEQ ID NO: 2773 - DNA, 22 bp, Artificial Sequence
  Description of Artificial Sequence: Synthetic oligonucleotide
ggcaaaatccgcaattactttt

SEQ ID NO: 2774 - DNA, 22 bp, Artificial Sequence
  Description of Artificial Sequence: Synthetic oligonucleotide
ggcaaaatccgcaattactttt

SEQ ID NO: 2775 - DNA, 22 bp, Artificial Sequence
  Description of Artificial Sequence: Synthetic oligonucleotide
ggcaaaatccgcaattactttt

SEQ ID NO: 2776 - DNA, 22 bp, Artificial Sequence
  Description of Artificial Sequence: Synthetic oligonucleotide
gacaaaaaccgcgattactttt

SEQ ID NO: 2777 - DNA, 22 bp, Artificial Sequence
  Description of Artificial Sequence: Synthetic oligonucleotide
gacaaaaaccgcgattactttt

SEQ ID NO: 2778 - DNA, 22 bp, Artificial Sequence
  Description of Artificial Sequence: Synthetic oligonucleotide
gacaaaaaccgcgattactttt

SEQ ID NO: 2779 - DNA, 22 bp, Artificial Sequence
  Description of Artificial Sequence: Synthetic oligonucleotide
gacaaaaaccgcgattactttt

SEQ ID NO: 2780 - DNA, 22 bp, Artificial Sequence
  Description of Artificial Sequence: Synthetic oligonucleotide
gtacaaaagtaattacagtttt

SEQ ID NO: 2781 - DNA, 19 bp, Artificial Sequence
  Description of Artificial Sequence: Synthetic oligonucleotide
aaaagtaattacagttttt

SEQ ID NO: 2782 - DNA, 19 bp, Artificial Sequence
  Description of Artificial Sequence: Synthetic oligonucleotide
aaaagtaattacagttttt

SEQ ID NO: 2783 - DNA, 19 bp, Artificial Sequence
  Description of Artificial Sequence: Synthetic oligonucleotide
aaaagtaattacagttttt

SEQ ID NO: 2784 - DNA, 19 bp, Artificial Sequence
  Description of Artificial Sequence: Synthetic oligonucleotide
aaaagtaattacagttttt

SEQ ID NO: 2785 - DNA, 19 bp, Artificial Sequence
  Description of Artificial Sequence: Synthetic oligonucleotide
aaaagtaattacagttttt

SEQ ID NO: 2786 - DNA, 22 bp, Artificial Sequence
  Description of Artificial Sequence: Synthetic oligonucleotide
tgagtattacatggccaatctc

SEQ ID NO: 2787 - DNA, 21 bp, Artificial Sequence
  Description of Artificial Sequence: Synthetic oligonucleotide
acaaaccacagtgtgctgctg

SEQ ID NO: 2788 - DNA, 21 bp, Artificial Sequence
  Description of Artificial Sequence: Synthetic oligonucleotide
aacccaatatcaaacatatca

SEQ ID NO: 2789 - DNA, 23 bp, Artificial Sequence
  Description of Artificial Sequence: Synthetic oligonucleotide
aggacctgcgggacaagattctt

SEQ ID NO: 2790 - DNA, 22 bp, Artificial Sequence
  Description of Artificial Sequence: Synthetic oligonucleotide
tgaaggtctactgtgtgccagg

SEQ ID NO: 2791 - DNA, 23 bp, Artificial Sequence
  Description of Artificial Sequence: Synthetic oligonucleotide
gaacagatagtctaaacactggg

SEQ ID NO: 2792 - DNA, 22 bp, Artificial Sequence
  Description of Artificial Sequence: Synthetic oligonucleotide
tcagtggctcaggttcgttgca

SEQ ID NO: 2793 - DNA, 22 bp, Artificial Sequence
  Description of Artificial Sequence: Synthetic oligonucleotide
atgcacctgggcaaggattctg

SEQ ID NO: 2794 - DNA, 22 bp, Artificial Sequence
  Description of Artificial Sequence: Synthetic oligonucleotide
tagcacatgctcaaacatccgt

SEQ ID NO: 2795 - DNA, 22 bp, Artificial Sequence
  Description of Artificial Sequence: Synthetic oligonucleotide
tagcacatgctcaaacatccgt

SEQ ID NO: 2796 - DNA, 22 bp, Artificial Sequence
  Description of Artificial Sequence: Synthetic oligonucleotide
ataaacgacacctccttgagaa

SEQ ID NO: 2797 - DNA, 22 bp, Artificial Sequence
  Description of Artificial Sequence: Synthetic oligonucleotide
ataaatgacacctccttgtgaa

SEQ ID NO: 2798 - DNA, 23 bp, Artificial Sequence
  Description of Artificial Sequence: Synthetic oligonucleotide
actgccctaagtgctccttctgg

SEQ ID NO: 2799 - DNA, 22 bp, Artificial Sequence
  Description of Artificial Sequence: Synthetic oligonucleotide
aaagtaactgcagtttttgcta

SEQ ID NO: 2800 - DNA, 22 bp, Artificial Sequence
  Description of Artificial Sequence: Synthetic oligonucleotide
tgcctactgagctgatatcagt

SEQ ID NO: 2801 - DNA, 23 bp, Artificial Sequence
  Description of Artificial Sequence: Synthetic oligonucleotide
agtaactggttgaacaactgtaa

SEQ ID NO: 2802 - DNA, 23 bp, Artificial Sequence
  Description of Artificial Sequence: Synthetic oligonucleotide
tgtcactcggctcggcccactac

SEQ ID NO: 2803 - DNA, 23 bp, Artificial Sequence
  Description of Artificial Sequence: Synthetic oligonucleotide
ttctcgaggaaagaagcactttc

SEQ ID NO: 2804 - DNA, 23 bp, Artificial Sequence
  Description of Artificial Sequence: Synthetic oligonucleotide
ttctcgaggaaagaagcactttc

SEQ ID NO: 2805 - DNA, 22 bp, Artificial Sequence
  Description of Artificial Sequence: Synthetic oligonucleotide
gctgcaaacatccgactgaaag

SEQ ID NO: 2806 - DNA, 22 bp, Artificial Sequence
  Description of Artificial Sequence: Synthetic oligonucleotide
agtgaattctaccagtgccata

SEQ ID NO: 2807 - DNA, 22 bp, Artificial Sequence
  Description of Artificial Sequence: Synthetic oligonucleotide
agcccaaaaggagaattctttg

SEQ ID NO: 2808 - DNA, 22 bp, Artificial Sequence
  Description of Artificial Sequence: Synthetic oligonucleotide
ccggctgcaacacaagacacga

SEQ ID NO: 2809 - DNA, 22 bp, Artificial Sequence
  Description of Artificial Sequence: Synthetic oligonucleotide
tggacggagaactgataagggt

SEQ ID NO: 2810 - DNA, 22 bp, Artificial Sequence
  Description of Artificial Sequence: Synthetic oligonucleotide
tggagagaaaggcagttcctga

SEQ ID NO: 2811 - DNA, 22 bp, Artificial Sequence
  Description of Artificial Sequence: Synthetic oligonucleotide
gaacctatctcccctctggacc

SEQ ID NO: 2812 - DNA, 22 bp, Artificial Sequence
  Description of Artificial Sequence: Synthetic oligonucleotide
tgaggtagtaggttgtgtggtt

SEQ ID NO: 2813 - DNA, 22 bp, Artificial Sequence
  Description of Artificial Sequence: Synthetic oligonucleotide
tatgtgcctttggactacatcg

SEQ ID NO: 2814 - DNA, 23 bp, Artificial Sequence
  Description of Artificial Sequence: Synthetic oligonucleotide
caaagcgcttctctttagagtgt

SEQ ID NO: 2815 - DNA, 23 bp, Artificial Sequence
  Description of Artificial Sequence: Synthetic oligonucleotide
tccagtaccacgtgtcagggcca

SEQ ID NO: 2816 - DNA, 22 bp, Artificial Sequence
  Description of Artificial Sequence: Synthetic oligonucleotide
tatgtaatatggtccacatctt

SEQ ID NO: 2817 - DNA, 22 bp, Artificial Sequence
  Description of Artificial Sequence: Synthetic oligonucleotide
tatacaagggcaagctctctgt

SEQ ID NO: 2818 - DNA, 22 bp, Artificial Sequence
  Description of Artificial Sequence: Synthetic oligonucleotide
gaagttgttcgtggtggattcg

SEQ ID NO: 2819 - DNA, 22 bp, Artificial Sequence
  Description of Artificial Sequence: Synthetic oligonucleotide
agccacaatcaccttctgatct

SEQ ID NO: 2820 - DNA, 20 bp, Artificial Sequence
  Description of Artificial Sequence: Synthetic oligonucleotide
tatgaacaatttctaggaat

SEQ ID NO: 2821 - DNA, 24 bp, Artificial Sequence
  Description of Artificial Sequence: Synthetic oligonucleotide
acgcgcaggccagagacccaggca

SEQ ID NO: 2822 - DNA, 23 bp, Artificial Sequence
  Description of Artificial Sequence: Synthetic oligonucleotide
gcgcccaattaatgtctgttgat

SEQ ID NO: 2823 - DNA, 21 bp, Artificial Sequence
  Description of Artificial Sequence: Synthetic oligonucleotide
gaaagcgcttctctttagagg

SEQ ID NO: 2824 - DNA, 22 bp, Artificial Sequence
  Description of Artificial Sequence: Synthetic oligonucleotide
tacccattgcatatcggagttg

SEQ ID NO: 2825 - DNA, 23 bp, Artificial Sequence
  Description of Artificial Sequence: Synthetic oligonucleotide
tcaacgggagtgatcgtgtcatt

SEQ ID NO: 2826 - DNA, 22 bp, Artificial Sequence
  Description of Artificial Sequence: Synthetic oligonucleotide
ttcaaaacatgaattgctgctg

SEQ ID NO: 2827 - DNA, 23 bp, Artificial Sequence
  Description of Artificial Sequence: Synthetic oligonucleotide
tctctggagggaagcactttctg

SEQ ID NO: 2828 - DNA, 22 bp, Artificial Sequence
  Description of Artificial Sequence: Synthetic oligonucleotide
aaacattcgcggtgcacttctt

SEQ ID NO: 2829 - DNA, 23 bp, Artificial Sequence
  Description of Artificial Sequence: Synthetic oligonucleotide
taaggtgcatctagtgcagatag

SEQ ID NO: 2830 - DNA, 22 bp, Artificial Sequence
  Description of Artificial Sequence: Synthetic oligonucleotide
gctacttcacaacaccagggcc

SEQ ID NO: 2831 - DNA, 22 bp, Artificial Sequence
  Description of Artificial Sequence: Synthetic oligonucleotide
ctatacggcctcctagctttcc

SEQ ID NO: 2832 - DNA, 22 bp, Artificial Sequence
  Description of Artificial Sequence: Synthetic oligonucleotide
gcacacaataaatgtttgctga

SEQ ID NO: 2833 - DNA, 21 bp, Artificial Sequence
  Description of Artificial Sequence: Synthetic oligonucleotide
agagctcatccatagttgtca

SEQ ID NO: 2834 - DNA, 21 bp, Artificial Sequence
  Description of Artificial Sequence: Synthetic oligonucleotide
tgacaactatggatgagctct

SEQ ID NO: 2835 - DNA, 22 bp, Artificial Sequence
  Description of Artificial Sequence: Synthetic oligonucleotide
tttggtccccttcaaccagctg

SEQ ID NO: 2836 - DNA, 22 bp, Artificial Sequence
  Description of Artificial Sequence: Synthetic oligonucleotide
cagctggttgaaggggaccaaa

SEQ ID NO: 2837 - DNA, 22 bp, Artificial Sequence
  Description of Artificial Sequence: Synthetic oligonucleotide
cacgctcatgcacacacccaca

SEQ ID NO: 2838 - DNA, 22 bp, Artificial Sequence
  Description of Artificial Sequence: Synthetic oligonucleotide
tttggtccccttcaaccagcta

SEQ ID NO: 2839 - DNA, 21 bp, Artificial Sequence
  Description of Artificial Sequence: Synthetic oligonucleotide
tccttctgctccgtcccccag

SEQ ID NO: 2840 - DNA, 22 bp, Artificial Sequence
  Description of Artificial Sequence: Synthetic oligonucleotide
agtcttcacaacagccctgtgt

SEQ ID NO: 2841 - DNA, 21 bp, Artificial Sequence
  Description of Artificial Sequence: Synthetic oligonucleotide
aataatacatggttgatcttt

SEQ ID NO: 2842 - DNA, 21 bp, Artificial Sequence
  Description of Artificial Sequence: Synthetic oligonucleotide
aaagcgcttcccttcagagtg

SEQ ID NO: 2843 - DNA, 22 bp, Artificial Sequence
  Description of Artificial Sequence: Synthetic oligonucleotide
ttctccaaaagggagcactttc

SEQ ID NO: 2844 - DNA, 22 bp, Artificial Sequence
  Description of Artificial Sequence: Synthetic oligonucleotide
cacaaaccattatgtgctgcta

SEQ ID NO: 2845 - DNA, 22 bp, Artificial Sequence
  Description of Artificial Sequence: Synthetic oligonucleotide
tgagacctctgggttctgagct

SEQ ID NO: 2846 - DNA, 22 bp, Artificial Sequence
  Description of Artificial Sequence: Synthetic oligonucleotide
tagcagcacatcatggtttaca

SEQ ID NO: 2847 - DNA, 23 bp, Artificial Sequence
  Description of Artificial Sequence: Synthetic oligonucleotide
aggttgtccgtggtgagttcgca

SEQ ID NO: 2848 - DNA, 22 bp, Artificial Sequence
  Description of Artificial Sequence: Synthetic oligonucleotide
tggtgattcacaaagaaatcca

SEQ ID NO: 2849 - DNA, 22 bp, Artificial Sequence
  Description of Artificial Sequence: Synthetic oligonucleotide
tcaccagccctgtgttccctag

SEQ ID NO: 2850 - DNA, 23 bp, Artificial Sequence
  Description of Artificial Sequence: Synthetic oligonucleotide
cagtaacaaagattcatccttgt

SEQ ID NO: 2851 - DNA, 21 bp, Artificial Sequence
  Description of Artificial Sequence: Synthetic oligonucleotide
ctccagagggaagtactttct

SEQ ID NO: 2852 - DNA, 21 bp, Artificial Sequence
  Description of Artificial Sequence: Synthetic oligonucleotide
ttgtctaaccagtcacctgtt

SEQ ID NO: 2853 - DNA, 22 bp, Artificial Sequence
  Description of Artificial Sequence: Synthetic oligonucleotide
gtgtgcggaaatgcttctgcta

SEQ ID NO: 2854 - DNA, 21 bp, Artificial Sequence
  Description of Artificial Sequence: Synthetic oligonucleotide
ctggatggctcctccatgtct

SEQ ID NO: 2855 - DNA, 21 bp, Artificial Sequence
  Description of Artificial Sequence: Synthetic oligonucleotide
aggaggcagcgctctcaggac

SEQ ID NO: 2856 - DNA, 22 bp, Artificial Sequence
  Description of Artificial Sequence: Synthetic oligonucleotide
cctctgaaattcagttcttcag

SEQ ID NO: 2857 - DNA, 23 bp, Artificial Sequence
  Description of Artificial Sequence: Synthetic oligonucleotide
tcaagagcaataacgaaaaatgt

SEQ ID NO: 2858 - DNA, 22 bp, Artificial Sequence
  Description of Artificial Sequence: Synthetic oligonucleotide
aaagtgcttctctttggtgggt

SEQ ID NO: 2859 - DNA, 23 bp, Artificial Sequence
  Description of Artificial Sequence: Synthetic oligonucleotide
agttttgcaggtttgcatccagc

SEQ ID NO: 2860 - DNA, 20 bp, Artificial Sequence
  Description of Artificial Sequence: Synthetic oligonucleotide
gtgtctgggcggacagctgc

SEQ ID NO: 2861 - DNA, 22 bp, Artificial Sequence
  Description of Artificial Sequence: Synthetic oligonucleotide
tgccctgtggactcagttctgg

SEQ ID NO: 2862 - DNA, 22 bp, Artificial Sequence
  Description of Artificial Sequence: Synthetic oligonucleotide
cacctgataaaactgaggtata

SEQ ID NO: 2863 - DNA, 22 bp, Artificial Sequence
  Description of Artificial Sequence: Synthetic oligonucleotide
tcggtccctcgggccagggcag

SEQ ID NO: 2864 - DNA, 21 bp, Artificial Sequence
  Description of Artificial Sequence: Synthetic oligonucleotide
aggagactcacaagttcctgc

SEQ ID NO: 2865 - DNA, 22 bp, Artificial Sequence
  Description of Artificial Sequence: Synthetic oligonucleotide
cgaatcattatttgctgctcta

SEQ ID NO: 2866 - DNA, 21 bp, Artificial Sequence
  Description of Artificial Sequence: Synthetic oligonucleotide
caattgcccaagtctccgcct

SEQ ID NO: 2867 - DNA, 21 bp, Artificial Sequence
  Description of Artificial Sequence: Synthetic oligonucleotide
agaggataccctttgtatgtt

SEQ ID NO: 2868 - DNA, 21 bp, Artificial Sequence
  Description of Artificial Sequence: Synthetic oligonucleotide
agaggataccctttgtatgtt

SEQ ID NO: 2869 - DNA, 17 bp, Artificial Sequence
  Description of Artificial Sequence: Synthetic oligonucleotide
tctcgctggggcctcca

SEQ ID NO: 2870 - DNA, 22 bp, Artificial Sequence
  Description of Artificial Sequence: Synthetic oligonucleotide
gaatgttgctcggtgaacccct

SEQ ID NO: 2871 - DNA, 23 bp, Artificial Sequence
  Description of Artificial Sequence: Synthetic oligonucleotide
gtcacatccctcccaagaccctc

SEQ ID NO: 2872 - DNA, 21 bp, Artificial Sequence
  Description of Artificial Sequence: Synthetic oligonucleotide
aagcattctttcattggttgg

SEQ ID NO: 2873 - DNA, 21 bp, Artificial Sequence
  Description of Artificial Sequence: Synthetic oligonucleotide
ctagggaagaacagtgagcaa

SEQ ID NO: 2874 - DNA, 22 bp, Artificial Sequence
  Description of Artificial Sequence: Synthetic oligonucleotide
agagttgcatattagcaacagt

SEQ ID NO: 2875 - DNA, 22 bp, Artificial Sequence
  Description of Artificial Sequence: Synthetic oligonucleotide
cactggtacaagggttgggaga

SEQ ID NO: 2876 - DNA, 22 bp, Artificial Sequence
  Description of Artificial Sequence: Synthetic oligonucleotide
gatcacttttgtgactatgcaa

SEQ ID NO: 2877 - DNA, 22 bp, Artificial Sequence
  Description of Artificial Sequence: Synthetic oligonucleotide
gatcacttttgtgactatgcaa

SEQ ID NO: 2878 - DNA, 21 bp, Artificial Sequence
  Description of Artificial Sequence: Synthetic oligonucleotide
ccaagttctgtcatgcactga

SEQ ID NO: 2879 - DNA, 23 bp, Artificial Sequence
  Description of Artificial Sequence: Synthetic oligonucleotide
ttaatgctaatcgtgataggggt

SEQ ID NO: 2880 - DNA, 22 bp, Artificial Sequence
  Description of Artificial Sequence: Synthetic oligonucleotide
taggttatccgtgttgccttcg

SEQ ID NO: 2881 - DNA, 22 bp, Artificial Sequence
  Description of Artificial Sequence: Synthetic oligonucleotide
aaccagcaccccaactttggac

SEQ ID NO: 2882 - DNA, 22 bp, Artificial Sequence
  Description of Artificial Sequence: Synthetic oligonucleotide
agaggttgcccttggtgaattc

SEQ ID NO: 2883 - DNA, 20 bp, Artificial Sequence
  Description of Artificial Sequence: Synthetic oligonucleotide
tcacacctgcctcgcccccc

SEQ ID NO: 2884 - DNA, 23 bp, Artificial Sequence
  Description of Artificial Sequence: Synthetic oligonucleotide
gaacaggtagtctgaacactggg

SEQ ID NO: 2885 - DNA, 23 bp, Artificial Sequence
  Description of Artificial Sequence: Synthetic oligonucleotide
gaacaggtagtctgaacactggg

SEQ ID NO: 2886 - DNA, 23 bp, Artificial Sequence
  Description of Artificial Sequence: Synthetic oligonucleotide
catgctcagacaaccatggtgca

SEQ ID NO: 2887 - DNA, 21 bp, Artificial Sequence
  Description of Artificial Sequence: Synthetic oligonucleotide
cctcaaggagcttcagtctag

SEQ ID NO: 2888 - DNA, 22 bp, Artificial Sequence
  Description of Artificial Sequence: Synthetic oligonucleotide
aatcatacacggttgacctatt

SEQ ID NO: 2889 - DNA, 22 bp, Artificial Sequence
  Description of Artificial Sequence: Synthetic oligonucleotide
ctcccttctttcctcccgtctt

SEQ ID NO: 2890 - DNA, 21 bp, Artificial Sequence
  Description of Artificial Sequence: Synthetic oligonucleotide
gtgcattgtagttgcattgca

SEQ ID NO: 2891 - DNA, 20 bp, Artificial Sequence
  Description of Artificial Sequence: Synthetic oligonucleotide
gcaatgcaacagcaatgcac

SEQ ID NO: 2892 - DNA, 22 bp, Artificial Sequence
  Description of Artificial Sequence: Synthetic oligonucleotide
cacatctcactgtagcctcaaa

SEQ ID NO: 2893 - DNA, 22 bp, Artificial Sequence
  Description of Artificial Sequence: Synthetic oligonucleotide
tcagaccgagacaagtgcaatg

SEQ ID NO: 2894 - DNA, 18 bp, Artificial Sequence
  Description of Artificial Sequence: Synthetic oligonucleotide
acgttggctctggtggtg

SEQ ID NO: 2895 - DNA, 22 bp, Artificial Sequence
  Description of Artificial Sequence: Synthetic oligonucleotide
cacgaccgacgccacgccgagt

SEQ ID NO: 2896 - DNA, 18 bp, Artificial Sequence
  Description of Artificial Sequence: Synthetic oligonucleotide
cagcagcctccttctcaa

SEQ ID NO: 2897 - DNA, 22 bp, Artificial Sequence
  Description of Artificial Sequence: Synthetic oligonucleotide
tagcttatcagactgatgttga

SEQ ID NO: 2898 - DNA, 22 bp, Artificial Sequence
  Description of Artificial Sequence: Synthetic oligonucleotide
acagttcttcaactggcagctt

SEQ ID NO: 2899 - DNA, 21 bp, Artificial Sequence
  Description of Artificial Sequence: Synthetic oligonucleotide
aagcctgcccggctcctcggg

SEQ ID NO: 2900 - DNA, 20 bp, Artificial Sequence
  Description of Artificial Sequence: Synthetic oligonucleotide
gtttgataaactgacacaac

SEQ ID NO: 2901 - DNA, 22 bp, Artificial Sequence
  Description of Artificial Sequence: Synthetic oligonucleotide
tgacgatgacaacgatgacgta

SEQ ID NO: 2902 - DNA, 21 bp, Artificial Sequence
  Description of Artificial Sequence: Synthetic oligonucleotide
tcccagcacacatttagctca

SEQ ID NO: 2903 - DNA, 21 bp, Artificial Sequence
  Description of Artificial Sequence: Synthetic oligonucleotide
tgagctaaatgtgtgctggga

SEQ ID NO: 2904 - DNA, 23 bp, Artificial Sequence
  Description of Artificial Sequence: Synthetic oligonucleotide
gtcagaccccgaggggtcctcgc

SEQ ID NO: 2905 - DNA, 22 bp, Artificial Sequence
  Description of Artificial Sequence: Synthetic oligonucleotide
ctgctcaaaccctccaatgact

SEQ ID NO: 2906 - DNA, 22 bp, Artificial Sequence
  Description of Artificial Sequence: Synthetic oligonucleotide
gccaccttcaaatgggaagtct

SEQ ID NO: 2907 - DNA, 23 bp, Artificial Sequence
  Description of Artificial Sequence: Synthetic oligonucleotide
gaacgcctgttcttgccaggtgg

SEQ ID NO: 2908 - DNA, 22 bp, Artificial Sequence
  Description of Artificial Sequence: Synthetic oligonucleotide
atcgtgcatccttttagagtgt

SEQ ID NO: 2909 - DNA, 22 bp, Artificial Sequence
  Description of Artificial Sequence: Synthetic oligonucleotide
tcgtgcatccctttagagtgtt

SEQ ID NO: 2910 - DNA, 22 bp, Artificial Sequence
  Description of Artificial Sequence: Synthetic oligonucleotide
atcgtgcatccctttagagtgt

SEQ ID NO: 2911 - DNA, 22 bp, Artificial Sequence
  Description of Artificial Sequence: Synthetic oligonucleotide
aaacaaacatggtgcacttctt

SEQ ID NO: 2912 - DNA, 21 bp, Artificial Sequence
  Description of Artificial Sequence: Synthetic oligonucleotide
tccggttctcagggctccacc

SEQ ID NO: 2913 - DNA, 22 bp, Artificial Sequence
  Description of Artificial Sequence: Synthetic oligonucleotide
cgccacggctccaatccctata

SEQ ID NO: 2914 - DNA, 23 bp, Artificial Sequence
  Description of Artificial Sequence: Synthetic oligonucleotide
ccttctcagaaaggtgaaattta

SEQ ID NO: 2915 - DNA, 23 bp, Artificial Sequence
  Description of Artificial Sequence: Synthetic oligonucleotide
ccttctcagaaaggtgaaattta

SEQ ID NO: 2916 - DNA, 21 bp, Artificial Sequence
  Description of Artificial Sequence: Synthetic oligonucleotide
ctccagagggatgcactttct

SEQ ID NO: 2917 - DNA, 22 bp, Artificial Sequence
  Description of Artificial Sequence: Synthetic oligonucleotide
tttgtgacctggtccactaacc

SEQ ID NO: 2918 - DNA, 22 bp, Artificial Sequence
  Description of Artificial Sequence: Synthetic oligonucleotide
gcccgggtcctgtgttgtagcc

SEQ ID NO: 2919 - DNA, 20 bp, Artificial Sequence
  Description of Artificial Sequence: Synthetic oligonucleotide
ctacaaagggaagccctttc

SEQ ID NO: 2920 - DNA, 22 bp, Artificial Sequence
  Description of Artificial Sequence: Synthetic oligonucleotide
ctctagagggaagcgctttctg

SEQ ID NO: 2921 - DNA, 21 bp, Artificial Sequence
  Description of Artificial Sequence: Synthetic oligonucleotide
tacagtactgtgataactgaa

SEQ ID NO: 2922 - DNA, 21 bp, Artificial Sequence
  Description of Artificial Sequence: Synthetic oligonucleotide
ttcagttatcacagtactgta

SEQ ID NO: 2923 - DNA, 22 bp, Artificial Sequence
  Description of Artificial Sequence: Synthetic oligonucleotide
tatgtgggatggtaaaccgctt

SEQ ID NO: 2924 - DNA, 23 bp, Artificial Sequence
  Description of Artificial Sequence: Synthetic oligonucleotide
tgatagccctgtacaatgctgct

SEQ ID NO: 2925 - DNA, 22 bp, Artificial Sequence
  Description of Artificial Sequence: Synthetic oligonucleotide
tagtactgtgcatatcatctat

SEQ ID NO: 2926 - DNA, 17 bp, Artificial Sequence
  Description of Artificial Sequence: Synthetic oligonucleotide
agaaagaagcaatatga

SEQ ID NO: 2927 - DNA, 22 bp, Artificial Sequence
  Description of Artificial Sequence: Synthetic oligonucleotide
agagttgagtctggacgtcccg

SEQ ID NO: 2928 - DNA, 22 bp, Artificial Sequence
  Description of Artificial Sequence: Synthetic oligonucleotide
tggtgggcacagaatctggact

SEQ ID NO: 2929 - DNA, 23 bp, Artificial Sequence
  Description of Artificial Sequence: Synthetic oligonucleotide
acacagctcttccatatctccag

SEQ ID NO: 2930 - DNA, 22 bp, Artificial Sequence
  Description of Artificial Sequence: Synthetic oligonucleotide
cttggcacctagcaagcactca

SEQ ID NO: 2931 - DNA, 26 bp, Artificial Sequence
  Description of Artificial Sequence: Synthetic oligonucleotide
tttcagaatttgctgccatcatcatc

SEQ ID NO: 2932 - DNA, 25 bp, Artificial Sequence
  Description of Artificial Sequence: Synthetic oligonucleotide
aagaaagagtcttgctttgtcgccc

SEQ ID NO: 2933 - DNA, 17 bp, Artificial Sequence
  Description of Artificial Sequence: Synthetic oligonucleotide
gacagcctctcccccac

SEQ ID NO: 2934 - DNA, 20 bp, Artificial Sequence
  Description of Artificial Sequence: Synthetic oligonucleotide
tgtctccacagggctcttta

SEQ ID NO: 2935 - DNA, 22 bp, Artificial Sequence
  Description of Artificial Sequence: Synthetic oligonucleotide
tacgtagatatatatgtatttt

SEQ ID NO: 2936 - DNA, 21 bp, Artificial Sequence
  Description of Artificial Sequence: Synthetic oligonucleotide
ttgagagtgccattatctggg

SEQ ID NO: 2937 - DNA, 22 bp, Artificial Sequence
  Description of Artificial Sequence: Synthetic oligonucleotide
acagatgtccagccacaattct

SEQ ID NO: 2938 - DNA, 21 bp, Artificial Sequence
  Description of Artificial Sequence: Synthetic oligonucleotide
agtagtgctttctactttatg

SEQ ID NO: 2939 - DNA, 22 bp, Artificial Sequence
  Description of Artificial Sequence: Synthetic oligonucleotide
tccgagcctgggtctccctctt

SEQ ID NO: 2940 - DNA, 22 bp, Artificial Sequence
  Description of Artificial Sequence: Synthetic oligonucleotide
cagtgcaatgatgaaagggcat

SEQ ID NO: 2941 - DNA, 21 bp, Artificial Sequence
  Description of Artificial Sequence: Synthetic oligonucleotide
tctactcagaagggtgcctta

SEQ ID NO: 2942 - DNA, 21 bp, Artificial Sequence
  Description of Artificial Sequence: Synthetic oligonucleotide
ttcactccaaaaggtgcaaaa

SEQ ID NO: 2943 - DNA, 22 bp, Artificial Sequence
  Description of Artificial Sequence: Synthetic oligonucleotide
gatagagtgcagaccagggtct

SEQ ID NO: 2944 - DNA, 22 bp, Artificial Sequence
  Description of Artificial Sequence: Synthetic oligonucleotide
agaggcagggtagtgtaatgga

SEQ ID NO: 2945 - DNA, 22 bp, Artificial Sequence
  Description of Artificial Sequence: Synthetic oligonucleotide
aaattattgtacatcggatgag

SEQ ID NO: 2946 - DNA, 23 bp, Artificial Sequence
  Description of Artificial Sequence: Synthetic oligonucleotide
taatccttgctacctgggtgaga

SEQ ID NO: 2947 - DNA, 22 bp, Artificial Sequence
  Description of Artificial Sequence: Synthetic oligonucleotide
ctatacgacctgctgcctttct

SEQ ID NO: 2948 - DNA, 22 bp, Artificial Sequence
  Description of Artificial Sequence: Synthetic oligonucleotide
tcatctaataaacatttactga

SEQ ID NO: 2949 - DNA, 22 bp, Artificial Sequence
  Description of Artificial Sequence: Synthetic oligonucleotide
tcttctctgttttggccatgtg

SEQ ID NO: 2950 - DNA, 22 bp, Artificial Sequence
  Description of Artificial Sequence: Synthetic oligonucleotide
catcttaccggacagtgctgga

SEQ ID NO: 2951 - DNA, 22 bp, Artificial Sequence
  Description of Artificial Sequence: Synthetic oligonucleotide
ttcacattgtgctactgtctgc

SEQ ID NO: 2952 - DNA, 23 bp, Artificial Sequence
  Description of Artificial Sequence: Synthetic oligonucleotide
agccctgttctacagccctgagg

SEQ ID NO: 2953 - DNA, 22 bp, Artificial Sequence
  Description of Artificial Sequence: Synthetic oligonucleotide
caaaactggcaattacttttgc

SEQ ID NO: 2954 - DNA, 22 bp, Artificial Sequence
  Description of Artificial Sequence: Synthetic oligonucleotide
caaaactggcaattacttttgc

SEQ ID NO: 2955 - DNA, 22 bp, Artificial Sequence
  Description of Artificial Sequence: Synthetic oligonucleotide
gcaaaagtaattgccagttttg

SEQ ID NO: 2956 - DNA, 23 bp, Artificial Sequence
  Description of Artificial Sequence: Synthetic oligonucleotide
gtttgcacgggtgggccttgtct

SEQ ID NO: 2957 - DNA, 20 bp, Artificial Sequence
  Description of Artificial Sequence: Synthetic oligonucleotide
cttcctcgtctgtctgcccc

SEQ ID NO: 2958 - DNA, 20 bp, Artificial Sequence
  Description of Artificial Sequence: Synthetic oligonucleotide
ggggagctgtggaagcagta

SEQ ID NO: 2959 - DNA, 25 bp, Artificial Sequence
  Description of Artificial Sequence: Synthetic oligonucleotide
gaatcctggttctgtccctcactag

SEQ ID NO: 2960 - DNA, 23 bp, Artificial Sequence
  Description of Artificial Sequence: Synthetic oligonucleotide
gacgtagtcctattctctgctgc

SEQ ID NO: 2961 - DNA, 21 bp, Artificial Sequence
  Description of Artificial Sequence: Synthetic oligonucleotide
agtttcttttcctccgctgac

SEQ ID NO: 2962 - DNA, 20 bp, Artificial Sequence
  Description of Artificial Sequence: Synthetic oligonucleotide
gcaagacatcacaagactct

SEQ ID NO: 2963 - DNA, 22 bp, Artificial Sequence
  Description of Artificial Sequence: Synthetic oligonucleotide
cggggttttgagggcgagatga

SEQ ID NO: 2964 - DNA, 21 bp, Artificial Sequence
  Description of Artificial Sequence: Synthetic oligonucleotide
actggacttggagtcagaagg

SEQ ID NO: 2965 - DNA, 20 bp, Artificial Sequence
  Description of Artificial Sequence: Synthetic oligonucleotide
aaaagctgggttgagagggt

SEQ ID NO: 2966 - DNA, 20 bp, Artificial Sequence
  Description of Artificial Sequence: Synthetic oligonucleotide
aaaagctgggttgagagggt

SEQ ID NO: 2967 - DNA, 22 bp, Artificial Sequence
  Description of Artificial Sequence: Synthetic oligonucleotide
ttgccctctcaacccagctttt

SEQ ID NO: 2968 - DNA, 22 bp, Artificial Sequence
  Description of Artificial Sequence: Synthetic oligonucleotide
aaaagctgggttgagagggcaa

SEQ ID NO: 2969 - DNA, 22 bp, Artificial Sequence
  Description of Artificial Sequence: Synthetic oligonucleotide
tcgccctctcaacccagctttt

SEQ ID NO: 2970 - DNA, 20 bp, Artificial Sequence
  Description of Artificial Sequence: Synthetic oligonucleotide
ccagcagcacctggggcagt

SEQ ID NO: 2971 - DNA, 22 bp, Artificial Sequence
  Description of Artificial Sequence: Synthetic oligonucleotide
gcctgctggggtggaacctggt

SEQ ID NO: 2972 - DNA, 22 bp, Artificial Sequence
  Description of Artificial Sequence: Synthetic oligonucleotide
caggtcgtcttgcagggcttct

SEQ ID NO: 2973 - DNA, 23 bp, Artificial Sequence
  Description of Artificial Sequence: Synthetic oligonucleotide
aaagtgctgcgacatttgagcgt

SEQ ID NO: 2974 - DNA, 22 bp, Artificial Sequence
  Description of Artificial Sequence: Synthetic oligonucleotide
tcacgcgagccgaacgaacaaa

SEQ ID NO: 2975 - DNA, 22 bp, Artificial Sequence
  Description of Artificial Sequence: Synthetic oligonucleotide
gccttctgaccctaagtccagt

SEQ ID NO: 2976 - DNA, 22 bp, Artificial Sequence
  Description of Artificial Sequence: Synthetic oligonucleotide
atcacacaaaggcaacttttgt

SEQ ID NO: 2977 - DNA, 22 bp, Artificial Sequence
  Description of Artificial Sequence: Synthetic oligonucleotide
aacacacctattcaaggattca

SEQ ID NO: 2978 - DNA, 23 bp, Artificial Sequence
  Description of Artificial Sequence: Synthetic oligonucleotide
aatcgcggtttataccaaatgaa

SEQ ID NO: 2979 - DNA, 21 bp, Artificial Sequence
  Description of Artificial Sequence: Synthetic oligonucleotide
cttcttgtgctctaggattgt

SEQ ID NO: 2980 - DNA, 22 bp, Artificial Sequence
  Description of Artificial Sequence: Synthetic oligonucleotide
ctgtgtttcagctcagtaggca

SEQ ID NO: 2981 - DNA, 24 bp, Artificial Sequence
  Description of Artificial Sequence: Synthetic oligonucleotide
ctgatcagttacacatcacttcag

SEQ ID NO: 2982 - DNA, 20 bp, Artificial Sequence
  Description of Artificial Sequence: Synthetic oligonucleotide
gtccgctcggcggtggccca

SEQ ID NO: 2983 - DNA, 21 bp, Artificial Sequence
  Description of Artificial Sequence: Synthetic oligonucleotide
tgagttggccatctgagtgag

SEQ ID NO: 2984 - DNA, 22 bp, Artificial Sequence
  Description of Artificial Sequence: Synthetic oligonucleotide
cgaaaacagcaattacctttgc

SEQ ID NO: 2985 - DNA, 21 bp, Artificial Sequence
  Description of Artificial Sequence: Synthetic oligonucleotide
tagataaaatattggtacctg

SEQ ID NO: 2986 - DNA, 22 bp, Artificial Sequence
  Description of Artificial Sequence: Synthetic oligonucleotide
aaagtgcttccttttagagggt

SEQ ID NO: 2987 - DNA, 22 bp, Artificial Sequence
  Description of Artificial Sequence: Synthetic oligonucleotide
catgattgccacgtctgcagta

SEQ ID NO: 2988 - DNA, 22 bp, Artificial Sequence
  Description of Artificial Sequence: Synthetic oligonucleotide
aaatcccatccccaggaacccc

SEQ ID NO: 2989 - DNA, 22 bp, Artificial Sequence
  Description of Artificial Sequence: Synthetic oligonucleotide
ctctagagggaagcactttctc

SEQ ID NO: 2990 - DNA, 22 bp, Artificial Sequence
  Description of Artificial Sequence: Synthetic oligonucleotide
ggagcagcacagccaatattgg

SEQ ID NO: 2991 - DNA, 22 bp, Artificial Sequence
  Description of Artificial Sequence: Synthetic oligonucleotide
attctaatttctccacgtcttt

SEQ ID NO: 2992 - DNA, 19 bp, Artificial Sequence
  Description of Artificial Sequence: Synthetic oligonucleotide
gctcctgtccaactggctc

SEQ ID NO: 2993 - DNA, 21 bp, Artificial Sequence
  Description of Artificial Sequence: Synthetic oligonucleotide
caacaccagtcgatgggctgt

SEQ ID NO: 2994 - DNA, 22 bp, Artificial Sequence
  Description of Artificial Sequence: Synthetic oligonucleotide
agagcttagctgattggtgaac

SEQ ID NO: 2995 - DNA, 23 bp, Artificial Sequence
  Description of Artificial Sequence: Synthetic oligonucleotide
tccaatcagttcctgatgcagta

SEQ ID NO: 2996 - DNA, 22 bp, Artificial Sequence
  Description of Artificial Sequence: Synthetic oligonucleotide
actgcctgtctgtgcctgctgt

SEQ ID NO: 2997 - DNA, 21 bp, Artificial Sequence
  Description of Artificial Sequence: Synthetic oligonucleotide
gtctgtcaattcataggtcat

SEQ ID NO: 2998 - DNA, 21 bp, Artificial Sequence
  Description of Artificial Sequence: Synthetic oligonucleotide
ggccgtgactggagactgtta

SEQ ID NO: 2999 - DNA, 22 bp, Artificial Sequence
  Description of Artificial Sequence: Synthetic oligonucleotide
tcagccgctgtcacacgcacag

SEQ ID NO: 3000 - DNA, 22 bp, Artificial Sequence
  Description of Artificial Sequence: Synthetic oligonucleotide
aggcgaaggatgacaaagggaa

SEQ ID NO: 3001 - DNA, 22 bp, Artificial Sequence
  Description of Artificial Sequence: Synthetic oligonucleotide
acaggccgggacaagtgcaata

SEQ ID NO: 3002 - DNA, 22 bp, Artificial Sequence
  Description of Artificial Sequence: Synthetic oligonucleotide
tattgcacttgtcccggcctgt

SEQ ID NO: 3003 - DNA, 22 bp, Artificial Sequence
  Description of Artificial Sequence: Synthetic oligonucleotide
tattgcactcgtcccggcctcc

SEQ ID NO: 3004 - DNA, 21 bp, Artificial Sequence
  Description of Artificial Sequence: Synthetic oligonucleotide
ttgtgcttgatctaaccatgt

SEQ ID NO: 3005 - DNA, 21 bp, Artificial Sequence
  Description of Artificial Sequence: Synthetic oligonucleotide
acatggttagatcaagcacaa

SEQ ID NO: 3006 - DNA, 22 bp, Artificial Sequence
  Description of Artificial Sequence: Synthetic oligonucleotide
gagtgccttcttttggagcgtt

SEQ ID NO: 3007 - DNA, 22 bp, Artificial Sequence
  Description of Artificial Sequence: Synthetic oligonucleotide
gagtgccttcttttggagcgtt

SEQ ID NO: 3008 - DNA, 22 bp, Artificial Sequence
  Description of Artificial Sequence: Synthetic oligonucleotide
atacatacttctttacattcca

SEQ ID NO: 3009 - DNA, 22 bp, Artificial Sequence
  Description of Artificial Sequence: Synthetic oligonucleotide
tggaatgtaaagaagtatgtat

SEQ ID NO: 3010 - DNA, 22 bp, Artificial Sequence
  Description of Artificial Sequence: Synthetic oligonucleotide
gggcggacacgacattcccgat

SEQ ID NO: 3011 - DNA, 22 bp, Artificial Sequence
  Description of Artificial Sequence: Synthetic oligonucleotide
aaaatggttccctttagagtgt

SEQ ID NO: 3012 - DNA, 23 bp, Artificial Sequence
  Description of Artificial Sequence: Synthetic oligonucleotide
acaacaaaatcactagtcttcca

SEQ ID NO: 3013 - DNA, 23 bp, Artificial Sequence
  Description of Artificial Sequence: Synthetic oligonucleotide
tggaagactagtgattttgttgt

SEQ ID NO: 3014 - DNA, 23 bp, Artificial Sequence
  Description of Artificial Sequence: Synthetic oligonucleotide
tggaagactagtgattttgttgt

SEQ ID NO: 3015 - DNA, 23 bp, Artificial Sequence
  Description of Artificial Sequence: Synthetic oligonucleotide
tctttggttatctagctgtatga

SEQ ID NO: 3016 - DNA, 23 bp, Artificial Sequence
  Description of Artificial Sequence: Synthetic oligonucleotide
tcatacagctagataaccaaaga

SEQ ID NO: 3017 - DNA, 23 bp, Artificial Sequence
  Description of Artificial Sequence: Synthetic oligonucleotide
tcatacagctagataaccaaaga

SEQ ID NO: 3018 - DNA, 22 bp, Artificial Sequence
  Description of Artificial Sequence: Synthetic oligonucleotide
gggggtccccggtgctcggatc

SEQ ID NO: 3019 - DNA, 22 bp, Artificial Sequence
  Description of Artificial Sequence: Synthetic oligonucleotide
aagtgctgtcatagctgaggtc

SEQ ID NO: 3020 - DNA, 22 bp, Artificial Sequence
  Description of Artificial Sequence: Synthetic oligonucleotide
aagtgctgtcatagctgaggtc

SEQ ID NO: 3021 - DNA, 22 bp, Artificial Sequence
  Description of Artificial Sequence: Synthetic oligonucleotide
caaagaagtatatgcataggaa

SEQ ID NO: 3022 - DNA, 22 bp, Artificial Sequence
  Description of Artificial Sequence: Synthetic oligonucleotide
ttcacccaaagaggtgtcagtc

SEQ ID NO: 3023 - DNA, 22 bp, Artificial Sequence
  Description of Artificial Sequence: Synthetic oligonucleotide
ggtgcagtgctgcatctctggt

SEQ ID NO: 3024 - DNA, 23 bp, Artificial Sequence
  Description of Artificial Sequence: Synthetic oligonucleotide
ctcttgagggaagcactttctgt

SEQ ID NO: 3025 - DNA, 21 bp, Artificial Sequence
  Description of Artificial Sequence: Synthetic oligonucleotide
aatattatacagtcaacctct

SEQ ID NO: 3026 - DNA, 23 bp, Artificial Sequence
  Description of Artificial Sequence: Synthetic oligonucleotide
cctagagagggtgagaacctgcc

SEQ ID NO: 3027 - DNA, 22 bp, Artificial Sequence
  Description of Artificial Sequence: Synthetic oligonucleotide
ataatacatggttaacctcttt

SEQ ID NO: 3028 - DNA, 21 bp, Artificial Sequence
  Description of Artificial Sequence: Synthetic oligonucleotide
aatggcgccactagggttgtg

SEQ ID NO: 3029 - DNA, 21 bp, Artificial Sequence
  Description of Artificial Sequence: Synthetic oligonucleotide
cagtagagattgtttcaacac

SEQ ID NO: 3030 - DNA, 22 bp, Artificial Sequence
  Description of Artificial Sequence: Synthetic oligonucleotide
gaaagcgcttccctttgctgga

SEQ ID NO: 3031 - DNA, 22 bp, Artificial Sequence
  Description of Artificial Sequence: Synthetic oligonucleotide
gaaagcgcttccctttgctgga

SEQ ID NO: 3032 - DNA, 22 bp, Artificial Sequence
  Description of Artificial Sequence: Synthetic oligonucleotide
tttaggataagcttgacttttg

SEQ ID NO: 3033 - DNA, 17 bp, Artificial Sequence
  Description of Artificial Sequence: Synthetic oligonucleotide
taattgcttccatgttt

SEQ ID NO: 3034 - DNA, 23 bp, Artificial Sequence
  Description of Artificial Sequence: Synthetic oligonucleotide
ggaagccatcaagtcgctgcagg

SEQ ID NO: 3035 - DNA, 23 bp, Artificial Sequence
  Description of Artificial Sequence: Synthetic oligonucleotide
cctgcagcgacttgatggcttcc

SEQ ID NO: 3036 - DNA, 23 bp, Artificial Sequence
  Description of Artificial Sequence: Synthetic oligonucleotide
ggaagccatcaagtcgctgcagg

SEQ ID NO: 3037 - DNA, 23 bp, Artificial Sequence
  Description of Artificial Sequence: Synthetic oligonucleotide
acactcaaacatggaagcactta

SEQ ID NO: 3038 - DNA, 23 bp, Artificial Sequence
  Description of Artificial Sequence: Synthetic oligonucleotide
ccactgaaacatggaagcactta

SEQ ID NO: 3039 - DNA, 23 bp, Artificial Sequence
  Description of Artificial Sequence: Synthetic oligonucleotide
ctactaaaacatggaagcactta

SEQ ID NO: 3040 - DNA, 22 bp, Artificial Sequence
  Description of Artificial Sequence: Synthetic oligonucleotide
acacacccacgcgagccggaaa

SEQ ID NO: 3041 - DNA, 21 bp, Artificial Sequence
  Description of Artificial Sequence: Synthetic oligonucleotide
cggctcgggtggcggcgacgg

SEQ ID NO: 3042 - DNA, 22 bp, Artificial Sequence
  Description of Artificial Sequence: Synthetic oligonucleotide
gctgggcttacgttgggagaac

SEQ ID NO: 3043 - DNA, 17 bp, Artificial Sequence
  Description of Artificial Sequence: Synthetic oligonucleotide
taagtgcttccatgctt

SEQ ID NO: 3044 - DNA, 23 bp, Artificial Sequence
  Description of Artificial Sequence: Synthetic oligonucleotide
tcatagccctgtacaatgctgct

SEQ ID NO: 3045 - DNA, 23 bp, Artificial Sequence
  Description of Artificial Sequence: Synthetic oligonucleotide
agcagcattgtacagggctatga

SEQ ID NO: 3046 - DNA, 22 bp, Artificial Sequence
  Description of Artificial Sequence: Synthetic oligonucleotide
cacaagttcggatctacgggtt

SEQ ID NO: 3047 - DNA, 22 bp, Artificial Sequence
  Description of Artificial Sequence: Synthetic oligonucleotide
gctatttcacgacaccagggtt

SEQ ID NO: 3048 - DNA, 22 bp, Artificial Sequence
  Description of Artificial Sequence: Synthetic oligonucleotide
aacgccattatcacactaaata

SEQ ID NO: 3049 - DNA, 23 bp, Artificial Sequence
  Description of Artificial Sequence: Synthetic oligonucleotide
accacaggagtctgagcatttga

SEQ ID NO: 3050 - DNA, 23 bp, Artificial Sequence
  Description of Artificial Sequence: Synthetic oligonucleotide
accacaggagtctgagcatttga

SEQ ID NO: 3051 - DNA, 22 bp, Artificial Sequence
  Description of Artificial Sequence: Synthetic oligonucleotide
cgtgtatttgacaagctgagtt

SEQ ID NO: 3052 - DNA, 22 bp, Artificial Sequence
  Description of Artificial Sequence: Synthetic oligonucleotide
aaattgcatcgtgatccacccg

SEQ ID NO: 3053 - DNA, 22 bp, Artificial Sequence
  Description of Artificial Sequence: Synthetic oligonucleotide
aaggagctcacagtctattgag

SEQ ID NO: 3054 - DNA, 22 bp, Artificial Sequence
  Description of Artificial Sequence: Synthetic oligonucleotide
ctgtcccccaggcctgtaccag

SEQ ID NO: 3055 - DNA, 22 bp, Artificial Sequence
  Description of Artificial Sequence: Synthetic oligonucleotide
caagctcgcttctatgggtctg

SEQ ID NO: 3056 - DNA, 18 bp, Artificial Sequence
  Description of Artificial Sequence: Synthetic oligonucleotide
tccagtgccctcctctcc

SEQ ID NO: 3057 - DNA, 22 bp, Artificial Sequence
  Description of Artificial Sequence: Synthetic oligonucleotide
aagcccttaccccaaaaagtat

SEQ ID NO: 3058 - DNA, 22 bp, Artificial Sequence
  Description of Artificial Sequence: Synthetic oligonucleotide
atattaccattagctcatcttt

SEQ ID NO: 3059 - DNA, 23 bp, Artificial Sequence
  Description of Artificial Sequence: Synthetic oligonucleotide
taccctgtagaaccgaatttgtg

SEQ ID NO: 3060 - DNA, 18 bp, Artificial Sequence
  Description of Artificial Sequence: Synthetic oligonucleotide
tgaggcagtagattgaat

SEQ ID NO: 3061 - DNA, 23 bp, Artificial Sequence
  Description of Artificial Sequence: Synthetic oligonucleotide
cacaaattcggatctacagggta

SEQ ID NO: 3062 - DNA, 23 bp, Artificial Sequence
  Description of Artificial Sequence: Synthetic oligonucleotide
atcccttgcaggggctgttgggt

SEQ ID NO: 3063 - DNA, 21 bp, Artificial Sequence
  Description of Artificial Sequence: Synthetic oligonucleotide
acagtctgctgaggttggagc

SEQ ID NO: 3064 - DNA, 21 bp, Artificial Sequence
  Description of Artificial Sequence: Synthetic oligonucleotide
ggctagcaacagcgcttacct

SEQ ID NO: 3065 - DNA, 20 bp, Artificial Sequence
  Description of Artificial Sequence: Synthetic oligonucleotide
atttctatatctatctccat

SEQ ID NO: 3066 - DNA, 22 bp, Artificial Sequence
  Description of Artificial Sequence: Synthetic oligonucleotide
ctgaagctcagagggctctgat

SEQ ID NO: 3067 - DNA, 19 bp, Artificial Sequence
  Description of Artificial Sequence: Synthetic oligonucleotide
agctgtctgaaaatgtctt

SEQ ID NO: 3068 - DNA, 21 bp, Artificial Sequence
  Description of Artificial Sequence: Synthetic oligonucleotide
ggactatagaactttccccct

SEQ ID NO: 3069 - DNA, 21 bp, Artificial Sequence
  Description of Artificial Sequence: Synthetic oligonucleotide
agggggaaagttctatagtcc

SEQ ID NO: 3070 - DNA, 21 bp, Artificial Sequence
  Description of Artificial Sequence: Synthetic oligonucleotide
tagttggcaagtctagaacca

SEQ ID NO: 3071 - DNA, 25 bp, Artificial Sequence
  Description of Artificial Sequence: Synthetic oligonucleotide
tgggaacgggttccggcagacgctg

SEQ ID NO: 3072 - DNA, 23 bp, Artificial Sequence
  Description of Artificial Sequence: Synthetic oligonucleotide
tctcacacagaaatcgcacccgt

SEQ ID NO: 3073 - DNA, 19 bp, Artificial Sequence
  Description of Artificial Sequence: Synthetic oligonucleotide
tccctgatccaaaaatcca

SEQ ID NO: 3074 - DNA, 24 bp, Artificial Sequence
  Description of Artificial Sequence: Synthetic oligonucleotide
actgctggtcttcagtcagggcca

SEQ ID NO: 3075 - DNA, 22 bp, Artificial Sequence
  Description of Artificial Sequence: Synthetic oligonucleotide
ggagatggagccagggccctaa

SEQ ID NO: 3076 - DNA, 17 bp, Artificial Sequence
  Description of Artificial Sequence: Synthetic oligonucleotide
cacctgaattacttgaa

SEQ ID NO: 3077 - DNA, 22 bp, Artificial Sequence
  Description of Artificial Sequence: Synthetic oligonucleotide
tgtgaggttggcattgttgtct

SEQ ID NO: 3078 - DNA, 22 bp, Artificial Sequence
  Description of Artificial Sequence: Synthetic oligonucleotide
ccccccactgggccgtacccac

SEQ ID NO: 3079 - DNA, 21 bp, Artificial Sequence
  Description of Artificial Sequence: Synthetic oligonucleotide
tgattgccactgtctgcagta

SEQ ID NO: 3080 - DNA, 21 bp, Artificial Sequence
  Description of Artificial Sequence: Synthetic oligonucleotide
tgattgccactgtctgcagta

SEQ ID NO: 3081 - DNA, 21 bp, Artificial Sequence
  Description of Artificial Sequence: Synthetic oligonucleotide
ccccacctcctctctcctcag

SEQ ID NO: 3082 - DNA, 21 bp, Artificial Sequence
  Description of Artificial Sequence: Synthetic oligonucleotide
taccacagggtagaaccacgg

SEQ ID NO: 3083 - DNA, 22 bp, Artificial Sequence
  Description of Artificial Sequence: Synthetic oligonucleotide
cctcccacacccaaggcttgca

SEQ ID NO: 3084 - DNA, 22 bp, Artificial Sequence
  Description of Artificial Sequence: Synthetic oligonucleotide
ttcattcggctgtccagatgta

SEQ ID NO: 3085 - DNA, 21 bp, Artificial Sequence
  Description of Artificial Sequence: Synthetic oligonucleotide
ttcaagtaattcaggataggt

SEQ ID NO: 3086 - DNA, 22 bp, Artificial Sequence
  Description of Artificial Sequence: Synthetic oligonucleotide
ggaaagacagtagactgtatag

SEQ ID NO: 3087 - DNA, 19 bp, Artificial Sequence
  Description of Artificial Sequence: Synthetic oligonucleotide
tagcatacagatacgccca

SEQ ID NO: 3088 - DNA, 20 bp, Artificial Sequence
  Description of Artificial Sequence: Synthetic oligonucleotide
ccatggatctccaggtgggt

SEQ ID NO: 3089 - DNA, 22 bp, Artificial Sequence
  Description of Artificial Sequence: Synthetic oligonucleotide
aaagtgcatctttttagaggat

SEQ ID NO: 3090 - DNA, 18 bp, Artificial Sequence
  Description of Artificial Sequence: Synthetic oligonucleotide
atgacacctccctgtgaa

SEQ ID NO: 3091 - DNA, 18 bp, Artificial Sequence
  Description of Artificial Sequence: Synthetic oligonucleotide
atgacacctccctgtgaa

SEQ ID NO: 3092 - DNA, 20 bp, Artificial Sequence
  Description of Artificial Sequence: Synthetic oligonucleotide
acaatgagaacccatggtct

SEQ ID NO: 3093 - DNA, 22 bp, Artificial Sequence
  Description of Artificial Sequence: Synthetic oligonucleotide
ggggacgaaatccaagcgcagc

SEQ ID NO: 3094 - DNA, 22 bp, Artificial Sequence
  Description of Artificial Sequence: Synthetic oligonucleotide
ttttcaactctaatgggagaga

SEQ ID NO: 3095 - DNA, 21 bp, Artificial Sequence
  Description of Artificial Sequence: Synthetic oligonucleotide
aggtaataccaataccttgtg

SEQ ID NO: 3096 - DNA, 19 bp, Artificial Sequence
  Description of Artificial Sequence: Synthetic oligonucleotide
tgtctctgctggggtttct

SEQ ID NO: 3097 - DNA, 23 bp, Artificial Sequence
  Description of Artificial Sequence: Synthetic oligonucleotide
tcaccaaaacatggaagcactta

SEQ ID NO: 3098 - DNA, 22 bp, Artificial Sequence
  Description of Artificial Sequence: Synthetic oligonucleotide
acatcatcgcatattgacacaa

SEQ ID NO: 3099 - DNA, 22 bp, Artificial Sequence
  Description of Artificial Sequence: Synthetic oligonucleotide
gcacaaatctccagaccaccca

SEQ ID NO: 3100 - DNA, 22 bp, Artificial Sequence
  Description of Artificial Sequence: Synthetic oligonucleotide
ctttcagtcggatgtttacagc

SEQ ID NO: 3101 - DNA, 23 bp, Artificial Sequence
  Description of Artificial Sequence: Synthetic oligonucleotide
tcttggagtaggtcattgggtgg

SEQ ID NO: 3102 - DNA, 21 bp, Artificial Sequence
  Description of Artificial Sequence: Synthetic oligonucleotide
agttctcccaacgtaaaccca

SEQ ID NO: 3103 - DNA, 22 bp, Artificial Sequence
  Description of Artificial Sequence: Synthetic oligonucleotide
catattggcactgcacatgatt

SEQ ID NO: 3104 - DNA, 24 bp, Artificial Sequence
  Description of Artificial Sequence: Synthetic oligonucleotide
gaagtcactcccaggcagctgcaa

SEQ ID NO: 3105 - DNA, 22 bp, Artificial Sequence
  Description of Artificial Sequence: Synthetic oligonucleotide
catcttactgggcagcattgga

SEQ ID NO: 3106 - DNA, 22 bp, Artificial Sequence
  Description of Artificial Sequence: Synthetic oligonucleotide
aaccatcgaccgttgagtggac

SEQ ID NO: 3107 - DNA, 23 bp, Artificial Sequence
  Description of Artificial Sequence: Synthetic oligonucleotide
tctactccaaaaggctacaatca

SEQ ID NO: 3108 - DNA, 22 bp, Artificial Sequence
  Description of Artificial Sequence: Synthetic oligonucleotide
tttagagacggggtcttgctct

SEQ ID NO: 3109 - DNA, 22 bp, Artificial Sequence
  Description of Artificial Sequence: Synthetic oligonucleotide
ggagaaattatccttggtgtgt

SEQ ID NO: 3110 - DNA, 22 bp, Artificial Sequence
  Description of Artificial Sequence: Synthetic oligonucleotide
acagattcgattctaggggaat

SEQ ID NO: 3111 - DNA, 25 bp, Artificial Sequence
  Description of Artificial Sequence: Synthetic oligonucleotide
gctgggcagggcttctgagctcctt

SEQ ID NO: 3112 - DNA, 20 bp, Artificial Sequence
  Description of Artificial Sequence: Synthetic oligonucleotide
aggaatgttccttctttgcc

SEQ ID NO: 3113 - DNA, 21 bp, Artificial Sequence
  Description of Artificial Sequence: Synthetic oligonucleotide
tcacccagatctgcggcctaa

SEQ ID NO: 3114 - DNA, 22 bp, Artificial Sequence
  Description of Artificial Sequence: Synthetic oligonucleotide
cccaacaacatgaaactaccta

SEQ ID NO: 3115 - DNA, 22 bp, Artificial Sequence
  Description of Artificial Sequence: Synthetic oligonucleotide
taggtagtttcatgttgttggg

SEQ ID NO: 3116 - DNA, 22 bp, Artificial Sequence
  Description of Artificial Sequence: Synthetic oligonucleotide
cccaacaacaggaaactaccta

SEQ ID NO: 3117 - DNA, 22 bp, Artificial Sequence
  Description of Artificial Sequence: Synthetic oligonucleotide
ggagagcctccacccaaccctc

SEQ ID NO: 3118 - DNA, 21 bp, Artificial Sequence
  Description of Artificial Sequence: Synthetic oligonucleotide
caaagcgcttccctttggagc

SEQ ID NO: 3119 - DNA, 18 bp, Artificial Sequence
  Description of Artificial Sequence: Synthetic oligonucleotide
ccactgaaccacccatgc

SEQ ID NO: 3120 - DNA, 22 bp, Artificial Sequence
  Description of Artificial Sequence: Synthetic oligonucleotide
gtaatgcaacaaatccccaccc

SEQ ID NO: 3121 - DNA, 25 bp, Artificial Sequence
  Description of Artificial Sequence: Synthetic oligonucleotide
accaacggacctacttccctccgcc

SEQ ID NO: 3122 - DNA, 22 bp, Artificial Sequence
  Description of Artificial Sequence: Synthetic oligonucleotide
gcagcaagtacccacagtgcgg

SEQ ID NO: 3123 - DNA, 22 bp, Artificial Sequence
  Description of Artificial Sequence: Synthetic oligonucleotide
aattacaatacaatctgataag

SEQ ID NO: 3124 - DNA, 21 bp, Artificial Sequence
  Description of Artificial Sequence: Synthetic oligonucleotide
agacacaccacggcacacttc

SEQ ID NO: 3125 - DNA, 22 bp, Artificial Sequence
  Description of Artificial Sequence: Synthetic oligonucleotide
ctctagagggaagcactttctg

SEQ ID NO: 3126 - DNA, 22 bp, Artificial Sequence
  Description of Artificial Sequence: Synthetic oligonucleotide
gagcttattcataaaagtgcag

SEQ ID NO: 3127 - DNA, 22 bp, Artificial Sequence
  Description of Artificial Sequence: Synthetic oligonucleotide
ttgcatatgtaggatgtcccat

SEQ ID NO: 3128 - DNA, 20 bp, Artificial Sequence
  Description of Artificial Sequence: Synthetic oligonucleotide
ctggaggaagggcccagagg

SEQ ID NO: 3129 - DNA, 23 bp, Artificial Sequence
  Description of Artificial Sequence: Synthetic oligonucleotide
acacttactggacacctactagg

SEQ ID NO: 3130 - DNA, 19 bp, Artificial Sequence
  Description of Artificial Sequence: Synthetic oligonucleotide
gtgtctgcttcctgtggga

SEQ ID NO: 3131 - DNA, 22 bp, Artificial Sequence
  Description of Artificial Sequence: Synthetic oligonucleotide
acggaagggcagagagggccag

SEQ ID NO: 3132 - DNA, 22 bp, Artificial Sequence
  Description of Artificial Sequence: Synthetic oligonucleotide
aacacacctggttaacctcttt

SEQ ID NO: 3133 - DNA, 22 bp, Artificial Sequence
  Description of Artificial Sequence: Synthetic oligonucleotide
aacacacctggttaacctcttt

SEQ ID NO: 3134 - DNA, 22 bp, Artificial Sequence
  Description of Artificial Sequence: Synthetic oligonucleotide
tggggaccctccctgaaccaag

SEQ ID NO: 3135 - DNA, 22 bp, Artificial Sequence
  Description of Artificial Sequence: Synthetic oligonucleotide
gcacagcaagtgtagacaggca

SEQ ID NO: 3136 - DNA, 21 bp, Artificial Sequence
  Description of Artificial Sequence: Synthetic oligonucleotide
aagacgggaggagaggagtga

SEQ ID NO: 3137 - DNA, 22 bp, Artificial Sequence
  Description of Artificial Sequence: Synthetic oligonucleotide
gtagattctccttctatgagta

SEQ ID NO: 3138 - DNA, 22 bp, Artificial Sequence
  Description of Artificial Sequence: Synthetic oligonucleotide
atggttccgtcaagcaccatgg

SEQ ID NO: 3139 - DNA, 22 bp, Artificial Sequence
  Description of Artificial Sequence: Synthetic oligonucleotide
gcaagtgcctccatgttaaagt

SEQ ID NO: 3140 - DNA, 22 bp, Artificial Sequence
  Description of Artificial Sequence: Synthetic oligonucleotide
gtgaacgggcgccatcccgagg

SEQ ID NO: 3141 - DNA, 22 bp, Artificial Sequence
  Description of Artificial Sequence: Synthetic oligonucleotide
tggttgaccatagaacatgcgc

SEQ ID NO: 3142 - DNA, 22 bp, Artificial Sequence
  Description of Artificial Sequence: Synthetic oligonucleotide
aaatatcacacacactaaattg

SEQ ID NO: 3143 - DNA, 21 bp, Artificial Sequence
  Description of Artificial Sequence: Synthetic oligonucleotide
ttaatatcggacaaccattgt

SEQ ID NO: 3144 - DNA, 26 bp, Artificial Sequence
  Description of Artificial Sequence: Synthetic oligonucleotide
atcactccgtactttcatcctccaac

SEQ ID NO: 3145 - DNA, 22 bp, Artificial Sequence
  Description of Artificial Sequence: Synthetic oligonucleotide
aatgcacccgggcaaggattct

SEQ ID NO: 3146 - DNA, 22 bp, Artificial Sequence
  Description of Artificial Sequence: Synthetic oligonucleotide
gtcatacacggctctcctctct

SEQ ID NO: 3147 - DNA, 22 bp, Artificial Sequence
  Description of Artificial Sequence: Synthetic oligonucleotide
gtggggtgggtggtcaggccga

SEQ ID NO: 3148 - DNA, 22 bp, Artificial Sequence
  Description of Artificial Sequence: Synthetic oligonucleotide
taaagcttgccactgaagaact

SEQ ID NO: 3149 - DNA, 24 bp, Artificial Sequence
  Description of Artificial Sequence: Synthetic oligonucleotide
tccctgagaccctttaacctgtga

SEQ ID NO: 3150 - DNA, 22 bp, Artificial Sequence
  Description of Artificial Sequence: Synthetic oligonucleotide
acttgtatgctagctcaggtag

SEQ ID NO: 3151 - DNA, 20 bp, Artificial Sequence
  Description of Artificial Sequence: Synthetic oligonucleotide
gcagaagcatttccacacac

SEQ ID NO: 3152 - DNA, 20 bp, Artificial Sequence
  Description of Artificial Sequence: Synthetic oligonucleotide
agtacatcatctatactgta

SEQ ID NO: 3153 - DNA, 23 bp, Artificial Sequence
  Description of Artificial Sequence: Synthetic oligonucleotide
gtccagttttcccaggaatccct

SEQ ID NO: 3154 - DNA, 21 bp, Artificial Sequence
  Description of Artificial Sequence: Synthetic oligonucleotide
tgagatgaagcactgtagctc

SEQ ID NO: 3155 - DNA, 22 bp, Artificial Sequence
  Description of Artificial Sequence: Synthetic oligonucleotide
tgtgtcactcgatgaccactgt

SEQ ID NO: 3156 - DNA, 22 bp, Artificial Sequence
  Description of Artificial Sequence: Synthetic oligonucleotide
taacactgtctggtaaagatgg

SEQ ID NO: 3157 - DNA, 23 bp, Artificial Sequence
  Description of Artificial Sequence: Synthetic oligonucleotide
cactcagccttgagggcactttc

SEQ ID NO: 3158 - DNA, 23 bp, Artificial Sequence
  Description of Artificial Sequence: Synthetic oligonucleotide
cactcagccttgagggcactttc

SEQ ID NO: 3159 - DNA, 22 bp, Artificial Sequence
  Description of Artificial Sequence: Synthetic oligonucleotide
aggtggtccgtggcgcgttcgc

SEQ ID NO: 3160 - DNA, 21 bp, Artificial Sequence
  Description of Artificial Sequence: Synthetic oligonucleotide
aacggaaccactagtgacttg

SEQ ID NO: 3161 - DNA, 22 bp, Artificial Sequence
  Description of Artificial Sequence: Synthetic oligonucleotide
tgtcagtttgtcaaatacccca

SEQ ID NO: 3162 - DNA, 21 bp, Artificial Sequence
  Description of Artificial Sequence: Synthetic oligonucleotide
acccagtagccagatgtagct

SEQ ID NO: 3163 - DNA, 23 bp, Artificial Sequence
  Description of Artificial Sequence: Synthetic oligonucleotide
gaaacccagcagacaatgtagct

SEQ ID NO: 3164 - DNA, 23 bp, Artificial Sequence
  Description of Artificial Sequence: Synthetic oligonucleotide
tctggctccgtgtcttcactccc

SEQ ID NO: 3165 - DNA, 22 bp, Artificial Sequence
  Description of Artificial Sequence: Synthetic oligonucleotide
aaagtgcttccctttggactgt

SEQ ID NO: 3166 - DNA, 22 bp, Artificial Sequence
  Description of Artificial Sequence: Synthetic oligonucleotide
aaaagtaattgcggtttttgcc

SEQ ID NO: 3167 - DNA, 22 bp, Artificial Sequence
  Description of Artificial Sequence: Synthetic oligonucleotide
cacttagcaggttgtattatat

SEQ ID NO: 3168 - DNA, 22 bp, Artificial Sequence
  Description of Artificial Sequence: Synthetic oligonucleotide
agcctatcctggattacttgaa

SEQ ID NO: 3169 - DNA, 22 bp, Artificial Sequence
  Description of Artificial Sequence: Synthetic oligonucleotide
ttcaagtaatccaggataggct

SEQ ID NO: 3170 - DNA, 22 bp, Artificial Sequence
  Description of Artificial Sequence: Synthetic oligonucleotide
cacttatcaggttgtattataa

SEQ ID NO: 3171 - DNA, 21 bp, Artificial Sequence
  Description of Artificial Sequence: Synthetic oligonucleotide
tttagcataagtatgtcccaa

SEQ ID NO: 3172 - DNA, 21 bp, Artificial Sequence
  Description of Artificial Sequence: Synthetic oligonucleotide
tttagcataagtatgtcccaa

SEQ ID NO: 3173 - DNA, 21 bp, Artificial Sequence
  Description of Artificial Sequence: Synthetic oligonucleotide
tttagcataagtatgtcccaa

SEQ ID NO: 3174 - DNA, 21 bp, Artificial Sequence
  Description of Artificial Sequence: Synthetic oligonucleotide
tttagcataagtatgtcccaa

SEQ ID NO: 3175 - DNA, 21 bp, Artificial Sequence
  Description of Artificial Sequence: Synthetic oligonucleotide
tttagcataagtatgtcccaa

SEQ ID NO: 3176 - DNA, 21 bp, Artificial Sequence
  Description of Artificial Sequence: Synthetic oligonucleotide
ttgggacatacttatgctaaa

SEQ ID NO: 3177 - DNA, 21 bp, Artificial Sequence
  Description of Artificial Sequence: Synthetic oligonucleotide
tttagcataagtatgtcccaa

SEQ ID NO: 3178 - DNA, 21 bp, Artificial Sequence
  Description of Artificial Sequence: Synthetic oligonucleotide
ttgggacatacttatgctaaa

SEQ ID NO: 3179 - DNA, 21 bp, Artificial Sequence
  Description of Artificial Sequence: Synthetic oligonucleotide
tttagcataagtatgtcccaa

SEQ ID NO: 3180 - DNA, 21 bp, Artificial Sequence
  Description of Artificial Sequence: Synthetic oligonucleotide
ttgggacatacttatgctaaa

SEQ ID NO: 3181 - DNA, 21 bp, Artificial Sequence
  Description of Artificial Sequence: Synthetic oligonucleotide
tttagcataagtatgtcccaa

SEQ ID NO: 3182 - DNA, 22 bp, Artificial Sequence
  Description of Artificial Sequence: Synthetic oligonucleotide
tgaacacaaggtactggtacta

SEQ ID NO: 3183 - DNA, 24 bp, Artificial Sequence
  Description of Artificial Sequence: Synthetic oligonucleotide
actgggcacaaacatgtccaggtc

SEQ ID NO: 3184 - DNA, 22 bp, Artificial Sequence
  Description of Artificial Sequence: Synthetic oligonucleotide
ggacctaaaaatacaatgcata

SEQ ID NO: 3185 - DNA, 21 bp, Artificial Sequence
  Description of Artificial Sequence: Synthetic oligonucleotide
tttccataggtgatgagtcac

SEQ ID NO: 3186 - DNA, 22 bp, Artificial Sequence
  Description of Artificial Sequence: Synthetic oligonucleotide
ctcagtcccaggcaaaccataa

SEQ ID NO: 3187 - DNA, 22 bp, Artificial Sequence
  Description of Artificial Sequence: Synthetic oligonucleotide
gcagcaaacatctgactgaaag

SEQ ID NO: 3188 - DNA, 22 bp, Artificial Sequence
  Description of Artificial Sequence: Synthetic oligonucleotide
atattaggaacacatcgcaaaa

SEQ ID NO: 3189 - DNA, 22 bp, Artificial Sequence
  Description of Artificial Sequence: Synthetic oligonucleotide
atattaggaacacatcgcaaaa

SEQ ID NO: 3190 - DNA, 21 bp, Artificial Sequence
  Description of Artificial Sequence: Synthetic oligonucleotide
caaagaggaaggtcccattac

SEQ ID NO: 3191 - DNA, 22 bp, Artificial Sequence
  Description of Artificial Sequence: Synthetic oligonucleotide
cctaatgattcatcattctcaa

SEQ ID NO: 3192 - DNA, 21 bp, Artificial Sequence
  Description of Artificial Sequence: Synthetic oligonucleotide
actgatctagagaacacaaga

SEQ ID NO: 3193 - DNA, 22 bp, Artificial Sequence
  Description of Artificial Sequence: Synthetic oligonucleotide
aagcccttaccccaaaaagcat

SEQ ID NO: 3194 - DNA, 22 bp, Artificial Sequence
  Description of Artificial Sequence: Synthetic oligonucleotide
ctaggtatggtcccagggatcc

SEQ ID NO: 3195 - DNA, 20 bp, Artificial Sequence
  Description of Artificial Sequence: Synthetic oligonucleotide
accaggaggctgaggcccct

SEQ ID NO: 3196 - DNA, 23 bp, Artificial Sequence
  Description of Artificial Sequence: Synthetic oligonucleotide
tgtaggctggggataaatgaata

SEQ ID NO: 3197 - DNA, 22 bp, Artificial Sequence
  Description of Artificial Sequence: Synthetic oligonucleotide
gcggtcccgcggcgccccgcct

SEQ ID NO: 3198 - DNA, 21 bp, Artificial Sequence
  Description of Artificial Sequence: Synthetic oligonucleotide
tcccacgttgtggcccagcag

SEQ ID NO: 3199 - DNA, 21 bp, Artificial Sequence
  Description of Artificial Sequence: Synthetic oligonucleotide
ttggccacaatgggttagaac

SEQ ID NO: 3200 - DNA, 22 bp, Artificial Sequence
  Description of Artificial Sequence: Synthetic oligonucleotide
ctcagagcagacgtggttctca

SEQ ID NO: 3201 - DNA, 21 bp, Artificial Sequence
  Description of Artificial Sequence: Synthetic oligonucleotide
aaagtgtcagatacggtgtgg

SEQ ID NO: 3202 - DNA, 21 bp, Artificial Sequence
  Description of Artificial Sequence: Synthetic oligonucleotide
ccaccaccgtgtctgacactt

SEQ ID NO: 3203 - DNA, 23 bp, Artificial Sequence
  Description of Artificial Sequence: Synthetic oligonucleotide
aagtgccgccatcttttgagtgt

SEQ ID NO: 3204 - DNA, 22 bp, Artificial Sequence
  Description of Artificial Sequence: Synthetic oligonucleotide
tgcggggctagggctaacagca

SEQ ID NO: 3205 - DNA, 22 bp, Artificial Sequence
  Description of Artificial Sequence: Synthetic oligonucleotide
tgtctactactggagacactgg

SEQ ID NO: 3206 - DNA, 22 bp, Artificial Sequence
  Description of Artificial Sequence: Synthetic oligonucleotide
cctctagtaaatatgtcagcat

SEQ ID NO: 3207 - DNA, 21 bp, Artificial Sequence
  Description of Artificial Sequence: Synthetic oligonucleotide
tgactgacagctttttgagta

SEQ ID NO: 3208 - DNA, 21 bp, Artificial Sequence
  Description of Artificial Sequence: Synthetic oligonucleotide
cattattacttttggtacgcg

SEQ ID NO: 3209 - DNA, 22 bp, Artificial Sequence
  Description of Artificial Sequence: Synthetic oligonucleotide
caagctcgtgtctgtgggtccg

SEQ ID NO: 3210 - DNA, 23 bp, Artificial Sequence
  Description of Artificial Sequence: Synthetic oligonucleotide
ctacgcgtattcttaagcaataa

SEQ ID NO: 3211 - DNA, 23 bp, Artificial Sequence
  Description of Artificial Sequence: Synthetic oligonucleotide
actccatttgttttgatgatgga

SEQ ID NO: 3212 - DNA, 21 bp, Artificial Sequence
  Description of Artificial Sequence: Synthetic oligonucleotide
agggagggacgggggctgtgc

SEQ ID NO: 3213 - DNA, 22 bp, Artificial Sequence
  Description of Artificial Sequence: Synthetic oligonucleotide
tgtgactggttgaccagagggg

SEQ ID NO: 3214 - DNA, 23 bp, Artificial Sequence
  Description of Artificial Sequence: Synthetic oligonucleotide
agctggtgttgtgaatcaggccg

SEQ ID NO: 3215 - DNA, 23 bp, Artificial Sequence
  Description of Artificial Sequence: Synthetic oligonucleotide
agctggtgttgtgaatcaggccg

SEQ ID NO: 3216 - DNA, 22 bp, Artificial Sequence
  Description of Artificial Sequence: Synthetic oligonucleotide
ctggactgagccgtgctactgg

SEQ ID NO: 3217 - DNA, 18 bp, Artificial Sequence
  Description of Artificial Sequence: Synthetic oligonucleotide
cccccaccaccacgcccg

SEQ ID NO: 3218 - DNA, 22 bp, Artificial Sequence
  Description of Artificial Sequence: Synthetic oligonucleotide
cggcaacaagaaactgcctgag

SEQ ID NO: 3219 - DNA, 22 bp, Artificial Sequence
  Description of Artificial Sequence: Synthetic oligonucleotide
ctggaagtgcccatactacagt

SEQ ID NO: 3220 - DNA, 22 bp, Artificial Sequence
  Description of Artificial Sequence: Synthetic oligonucleotide
taaccaatgtgcagactactgt

SEQ ID NO: 3221 - DNA, 22 bp, Artificial Sequence
  Description of Artificial Sequence: Synthetic oligonucleotide
taaccaatgtgcagactactgt

SEQ ID NO: 3222 - DNA, 22 bp, Artificial Sequence
  Description of Artificial Sequence: Synthetic oligonucleotide
actcagtatgccagggtaccat

SEQ ID NO: 3223 - DNA, 22 bp, Artificial Sequence
  Description of Artificial Sequence: Synthetic oligonucleotide
atccttctacaaattcacccat

SEQ ID NO: 3224 - DNA, 19 bp, Artificial Sequence
  Description of Artificial Sequence: Synthetic oligonucleotide
aagccaaagccttatccat

SEQ ID NO: 3225 - DNA, 18 bp, Artificial Sequence
  Description of Artificial Sequence: Synthetic oligonucleotide
atcccacctctgccacca

SEQ ID NO: 3226 - DNA, 21 bp, Artificial Sequence
  Description of Artificial Sequence: Synthetic oligonucleotide
tggggattacacttcaacagg

SEQ ID NO: 3227 - DNA, 21 bp, Artificial Sequence
  Description of Artificial Sequence: Synthetic oligonucleotide
actagactgtgagctcctcga

SEQ ID NO: 3228 - DNA, 22 bp, Artificial Sequence
  Description of Artificial Sequence: Synthetic oligonucleotide
caggatgtggtcaagtgttgtt

SEQ ID NO: 3229 - DNA, 23 bp, Artificial Sequence
  Description of Artificial Sequence: Synthetic oligonucleotide
caagtcttatttgagcacctgtt

SEQ ID NO: 3230 - DNA, 22 bp, Artificial Sequence
  Description of Artificial Sequence: Synthetic oligonucleotide
tcacaagtcaggctcttgggac

SEQ ID NO: 3231 - DNA, 22 bp, Artificial Sequence
  Description of Artificial Sequence: Synthetic oligonucleotide
caatgtttccacagtgcatcac

SEQ ID NO: 3232 - DNA, 23 bp, Artificial Sequence
  Description of Artificial Sequence: Synthetic oligonucleotide
cgtgagctcctggaggacaggga

SEQ ID NO: 3233 - DNA, 22 bp, Artificial Sequence
  Description of Artificial Sequence: Synthetic oligonucleotide
ctagaagctcacagtctagttg

SEQ ID NO: 3234 - DNA, 23 bp, Artificial Sequence
  Description of Artificial Sequence: Synthetic oligonucleotide
aatctactttctttgctcatcct

SEQ ID NO: 3235 - DNA, 22 bp, Artificial Sequence
  Description of Artificial Sequence: Synthetic oligonucleotide
aaccactttctttgctcatccg

SEQ ID NO: 3236 - DNA, 22 bp, Artificial Sequence
  Description of Artificial Sequence: Synthetic oligonucleotide
cggatgagcaaagaaagtggtt

SEQ ID NO: 3237 - DNA, 22 bp, Artificial Sequence
  Description of Artificial Sequence: Synthetic oligonucleotide
tatggcagactgtgatttgttg

SEQ ID NO: 3238 - DNA, 22 bp, Artificial Sequence
  Description of Artificial Sequence: Synthetic oligonucleotide
taaccaatgtgcagactactgt

SEQ ID NO: 3239 - DNA, 24 bp, Artificial Sequence
  Description of Artificial Sequence: Synthetic oligonucleotide
gaggtgactctatcctatgtcttt

SEQ ID NO: 3240 - DNA, 22 bp, Artificial Sequence
  Description of Artificial Sequence: Synthetic oligonucleotide
aactggcctacaaagtcccagt

SEQ ID NO: 3241 - DNA, 22 bp, Artificial Sequence
  Description of Artificial Sequence: Synthetic oligonucleotide
cccaaaaaattcacctttgggc

SEQ ID NO: 3242 - DNA, 22 bp, Artificial Sequence
  Description of Artificial Sequence: Synthetic oligonucleotide
ctggagacacgtgcactgtaga

SEQ ID NO: 3243 - DNA, 23 bp, Artificial Sequence
  Description of Artificial Sequence: Synthetic oligonucleotide
aggaagccctggaggggctggag

SEQ ID NO: 3244 - DNA, 22 bp, Artificial Sequence
  Description of Artificial Sequence: Synthetic oligonucleotide
ggttcagttgttcaaccagtta

SEQ ID NO: 3245 - DNA, 22 bp, Artificial Sequence
  Description of Artificial Sequence: Synthetic oligonucleotide
ggcaaaaaccacaattactttt

SEQ ID NO: 3246 - DNA, 22 bp, Artificial Sequence
  Description of Artificial Sequence: Synthetic oligonucleotide
ggcaaaaaccacaattactttt

SEQ ID NO: 3247 - DNA, 21 bp, Artificial Sequence
  Description of Artificial Sequence: Synthetic oligonucleotide
actctttccctgttgcactac

SEQ ID NO: 3248 - DNA, 22 bp, Artificial Sequence
  Description of Artificial Sequence: Synthetic oligonucleotide
ctatacaatctattgccttccc

SEQ ID NO: 3249 - DNA, 23 bp, Artificial Sequence
  Description of Artificial Sequence: Synthetic oligonucleotide
agaaaccatggggtatgagcaga

SEQ ID NO: 3250 - DNA, 22 bp, Artificial Sequence
  Description of Artificial Sequence: Synthetic oligonucleotide
tacagatggataccgtgcaatt

SEQ ID NO: 3251 - DNA, 22 bp, Artificial Sequence
  Description of Artificial Sequence: Synthetic oligonucleotide
tgcaacttagtaatgtgcaata

SEQ ID NO: 3252 - DNA, 21 bp, Artificial Sequence
  Description of Artificial Sequence: Synthetic oligonucleotide
agctatgccagcatcttgcct

SEQ ID NO: 3253 - DNA, 22 bp, Artificial Sequence
  Description of Artificial Sequence: Synthetic oligonucleotide
gaaggcgcttccctttagagcg

SEQ ID NO: 3254 - DNA, 23 bp, Artificial Sequence
  Description of Artificial Sequence: Synthetic oligonucleotide
aacattcattgttgtcggtgggt

SEQ ID NO: 3255 - DNA, 20 bp, Artificial Sequence
  Description of Artificial Sequence: Synthetic oligonucleotide
gtgtgtatacatttatacat

SEQ ID NO: 3256 - DNA, 22 bp, Artificial Sequence
  Description of Artificial Sequence: Synthetic oligonucleotide
ggccaaaaccacaattactttt

SEQ ID NO: 3257 - DNA, 21 bp, Artificial Sequence
  Description of Artificial Sequence: Synthetic oligonucleotide
taaagtaaatatgcaccaaaa

SEQ ID NO: 3258 - DNA, 21 bp, Artificial Sequence
  Description of Artificial Sequence: Synthetic oligonucleotide
ttttggtgcatatttacttta

SEQ ID NO: 3259 - DNA, 23 bp, Artificial Sequence
  Description of Artificial Sequence: Synthetic oligonucleotide
aacattcaacgctgtcggtgagt

SEQ ID NO: 3260 - DNA, 23 bp, Artificial Sequence
  Description of Artificial Sequence: Synthetic oligonucleotide
actcaccgacagcgttgaatgtt

SEQ ID NO: 3261 - DNA, 23 bp, Artificial Sequence
  Description of Artificial Sequence: Synthetic oligonucleotide
aacattcattgctgtcggtgggt

SEQ ID NO: 3262 - DNA, 23 bp, Artificial Sequence
  Description of Artificial Sequence: Synthetic oligonucleotide
acccaccgacagcaatgaatgtt

SEQ ID NO: 3263 - DNA, 22 bp, Artificial Sequence
  Description of Artificial Sequence: Synthetic oligonucleotide
aacattcaacctgtcggtgagt

SEQ ID NO: 3264 - DNA, 23 bp, Artificial Sequence
  Description of Artificial Sequence: Synthetic oligonucleotide
taggcagtgtcattagctgattg

SEQ ID NO: 3265 - DNA, 21 bp, Artificial Sequence
  Description of Artificial Sequence: Synthetic oligonucleotide
catcccttgcatggtggaggg

SEQ ID NO: 3266 - DNA, 22 bp, Artificial Sequence
  Description of Artificial Sequence: Synthetic oligonucleotide
tcaccattgctaaagtgcaatt

SEQ ID NO: 3267 - DNA, 22 bp, Artificial Sequence
  Description of Artificial Sequence: Synthetic oligonucleotide
taatgcccctaaaaatccttat

SEQ ID NO: 3268 - DNA, 22 bp, Artificial Sequence
  Description of Artificial Sequence: Synthetic oligonucleotide
taatgcccctaaaaatccttat

SEQ ID NO: 3269 - DNA, 22 bp, Artificial Sequence
  Description of Artificial Sequence: Synthetic oligonucleotide
gccagctaacaatacactgcct

SEQ ID NO: 3270 - DNA, 22 bp, Artificial Sequence
  Description of Artificial Sequence: Synthetic oligonucleotide
ctgaacaccaaaagaaatcagt

SEQ ID NO: 3271 - DNA, 22 bp, Artificial Sequence
  Description of Artificial Sequence: Synthetic oligonucleotide
tagagttacaccctgggagtta

SEQ ID NO: 3272 - DNA, 19 bp, Artificial Sequence
  Description of Artificial Sequence: Synthetic oligonucleotide
tgagctgctgtaccaaaat

SEQ ID NO: 3273 - DNA, 22 bp, Artificial Sequence
  Description of Artificial Sequence: Synthetic oligonucleotide
tattcccctagatacgaatttg

SEQ ID NO: 3274 - DNA, 22 bp, Artificial Sequence
  Description of Artificial Sequence: Synthetic oligonucleotide
ctctagagggaagcgctttctg

SEQ ID NO: 3275 - DNA, 22 bp, Artificial Sequence
  Description of Artificial Sequence: Synthetic oligonucleotide
caaagtttaagatccttgaagt

SEQ ID NO: 3276 - DNA, 20 bp, Artificial Sequence
  Description of Artificial Sequence: Synthetic oligonucleotide
aaagtagctgtaccatttgc

SEQ ID NO: 3277 - DNA, 19 bp, Artificial Sequence
  Description of Artificial Sequence: Synthetic oligonucleotide
aggttgacatacgtttccc

SEQ ID NO: 3278 - DNA, 22 bp, Artificial Sequence
  Description of Artificial Sequence: Synthetic oligonucleotide
gtacccctggagattctgataa

SEQ ID NO: 3279 - DNA, 19 bp, Artificial Sequence
  Description of Artificial Sequence: Synthetic oligonucleotide
gggcgcctgtgatcccaac

SEQ ID NO: 3280 - DNA, 23 bp, Artificial Sequence
  Description of Artificial Sequence: Synthetic oligonucleotide
agtatgttcttccaggacagaac

SEQ ID NO: 3281 - DNA, 22 bp, Artificial Sequence
  Description of Artificial Sequence: Synthetic oligonucleotide
gtccctctccaaatgtgtcttg

SEQ ID NO: 3282 - DNA, 22 bp, Artificial Sequence
  Description of Artificial Sequence: Synthetic oligonucleotide
ctgtgacctatggaattggcag

SEQ ID NO: 3283 - DNA, 23 bp, Artificial Sequence
  Description of Artificial Sequence: Synthetic oligonucleotide
aggttgggatcggttgcaatgct

SEQ ID NO: 3284 - DNA, 22 bp, Artificial Sequence
  Description of Artificial Sequence: Synthetic oligonucleotide
tgctcacaagcagctaagccct

SEQ ID NO: 3285 - DNA, 19 bp, Artificial Sequence
  Description of Artificial Sequence: Synthetic oligonucleotide
aggcacggtgtcagcaggc

SEQ ID NO: 3286 - DNA, 22 bp, Artificial Sequence
  Description of Artificial Sequence: Synthetic oligonucleotide
gtaagaagtgcttacattgcag

SEQ ID NO: 3287 - DNA, 22 bp, Artificial Sequence
  Description of Artificial Sequence: Synthetic oligonucleotide
cctattcttggttacttgcacg

SEQ ID NO: 3288 - DNA, 23 bp, Artificial Sequence
  Description of Artificial Sequence: Synthetic oligonucleotide
tttcaagccagggggcgtttttc

SEQ ID NO: 3289 - DNA, 22 bp, Artificial Sequence
  Description of Artificial Sequence: Synthetic oligonucleotide
gcagagacaatattgatagggt

SEQ ID NO: 3290 - DNA, 21 bp, Artificial Sequence
  Description of Artificial Sequence: Synthetic oligonucleotide
atccttgctatctgggtgcta

SEQ ID NO: 3291 - DNA, 22 bp, Artificial Sequence
  Description of Artificial Sequence: Synthetic oligonucleotide
cgcggtgcttgacagaaccatg

SEQ ID NO: 3292 - DNA, 22 bp, Artificial Sequence
  Description of Artificial Sequence: Synthetic oligonucleotide
agagtaaacagccttctcccag

SEQ ID NO: 3293 - DNA, 22 bp, Artificial Sequence
  Description of Artificial Sequence: Synthetic oligonucleotide
gaaagtgcttccttttagaggc

SEQ ID NO: 3294 - DNA, 23 bp, Artificial Sequence
  Description of Artificial Sequence: Synthetic oligonucleotide
tctcgtgacatgatgatccccga

SEQ ID NO: 3295 - DNA, 22 bp, Artificial Sequence
  Description of Artificial Sequence: Synthetic oligonucleotide
atcatgatgggctcctcggtgt

SEQ ID NO: 3296 - DNA, 21 bp, Artificial Sequence
  Description of Artificial Sequence: Synthetic oligonucleotide
gcggaacttagccactgtgaa

SEQ ID NO: 3297 - DNA, 21 bp, Artificial Sequence
  Description of Artificial Sequence: Synthetic oligonucleotide
ttcacagtggctaagttctgc

SEQ ID NO: 3298 - DNA, 23 bp, Artificial Sequence
  Description of Artificial Sequence: Synthetic oligonucleotide
tctctgcaggccgtgtgctttgc

SEQ ID NO: 3299 - DNA, 21 bp, Artificial Sequence
  Description of Artificial Sequence: Synthetic oligonucleotide
tgtcttgcaggccgtcatgca

SEQ ID NO: 3300 - DNA, 22 bp, Artificial Sequence
  Description of Artificial Sequence: Synthetic oligonucleotide
ctctagagggaagcactttctg

SEQ ID NO: 3301 - DNA, 23 bp, Artificial Sequence
  Description of Artificial Sequence: Synthetic oligonucleotide
cccagctagattgtaagctcctt

SEQ ID NO: 3302 - DNA, 22 bp, Artificial Sequence
  Description of Artificial Sequence: Synthetic oligonucleotide
actgcagtgaaggcacttgtag

SEQ ID NO: 3303 - DNA, 21 bp, Artificial Sequence
  Description of Artificial Sequence: Synthetic oligonucleotide
taggacacatggtctacttct

SEQ ID NO: 3304 - DNA, 22 bp, Artificial Sequence
  Description of Artificial Sequence: Synthetic oligonucleotide
ggtaaaactcgcaattactttt

SEQ ID NO: 3305 - DNA, 27 bp, Artificial Sequence
  Description of Artificial Sequence: Synthetic oligonucleotide
accttcttgtataagcactgtgctaaa

SEQ ID NO: 3306 - DNA, 22 bp, Artificial Sequence
  Description of Artificial Sequence: Synthetic oligonucleotide
acaaaccttttgttcgtcttat

SEQ ID NO: 3307 - DNA, 22 bp, Artificial Sequence
  Description of Artificial Sequence: Synthetic oligonucleotide
acaagctttttgctcgtcttat

SEQ ID NO: 3308 - DNA, 21 bp, Artificial Sequence
  Description of Artificial Sequence: Synthetic oligonucleotide
ttaagacttgcagtgatgttt

SEQ ID NO: 3309 - DNA, 24 bp, Artificial Sequence
  Description of Artificial Sequence: Synthetic oligonucleotide
tctaaaccaccatatgaaaccagc

SEQ ID NO: 3310 - DNA, 22 bp, Artificial Sequence
  Description of Artificial Sequence: Synthetic oligonucleotide
ctcctgactccaggtcctgtgt

SEQ ID NO: 3311 - DNA, 22 bp, Artificial Sequence
  Description of Artificial Sequence: Synthetic oligonucleotide
tcagcagcacagttaatactgg

SEQ ID NO: 3312 - DNA, 22 bp, Artificial Sequence
  Description of Artificial Sequence: Synthetic oligonucleotide
caacaaaatcactgatgctgga

SEQ ID NO: 3313 - DNA, 22 bp, Artificial Sequence
  Description of Artificial Sequence: Synthetic oligonucleotide
ggattcctggaaatactgttct

SEQ ID NO: 3314 - DNA, 22 bp, Artificial Sequence
  Description of Artificial Sequence: Synthetic oligonucleotide
ctcctatatgatgcctttcttc

SEQ ID NO: 3315 - DNA, 25 bp, Artificial Sequence
  Description of Artificial Sequence: Synthetic oligonucleotide
aggcaccagccaggcattgctcagc

SEQ ID NO: 3316 - DNA, 22 bp, Artificial Sequence
  Description of Artificial Sequence: Synthetic oligonucleotide
cagtgcaatgttaaaagggcat

SEQ ID NO: 3317 - DNA, 22 bp, Artificial Sequence
  Description of Artificial Sequence: Synthetic oligonucleotide
tcctcttttcttagagactcac

SEQ ID NO: 3318 - DNA, 22 bp, Artificial Sequence
  Description of Artificial Sequence: Synthetic oligonucleotide
tctacccagaaaggagccagtg

SEQ ID NO: 3319 - DNA, 21 bp, Artificial Sequence
  Description of Artificial Sequence: Synthetic oligonucleotide
ctacgcagaaaggacacagtg

SEQ ID NO: 3320 - DNA, 22 bp, Artificial Sequence
  Description of Artificial Sequence: Synthetic oligonucleotide
acaaaatccacaattacttttg

SEQ ID NO: 3321 - DNA, 28 bp, Artificial Sequence
  Description of Artificial Sequence: Synthetic oligonucleotide
gtcagcagtttgagtgtcagcattgtga

SEQ ID NO: 3322 - DNA, 22 bp, Artificial Sequence
  Description of Artificial Sequence: Synthetic oligonucleotide
agtattctgtaccagggaaggt

SEQ ID NO: 3323 - DNA, 21 bp, Artificial Sequence
  Description of Artificial Sequence: Synthetic oligonucleotide
gctgaggtctgggccaggtct

SEQ ID NO: 3324 - DNA, 22 bp, Artificial Sequence
  Description of Artificial Sequence: Synthetic oligonucleotide
gactcgaaccactgatccagca

SEQ ID NO: 3325 - DNA, 23 bp, Artificial Sequence
  Description of Artificial Sequence: Synthetic oligonucleotide
ctaatagtatctaccacaataaa

SEQ ID NO: 3326 - DNA, 17 bp, Artificial Sequence
  Description of Artificial Sequence: Synthetic oligonucleotide
tcgcctcctcctctccc

SEQ ID NO: 3327 - DNA, 23 bp, Artificial Sequence
  Description of Artificial Sequence: Synthetic oligonucleotide
ggacattgtttcagtgcccaagt

SEQ ID NO: 3328 - DNA, 23 bp, Artificial Sequence
  Description of Artificial Sequence: Synthetic oligonucleotide
tgcgggcgggacgagcaagcaca

SEQ ID NO: 3329 - DNA, 24 bp, Artificial Sequence
  Description of Artificial Sequence: Synthetic oligonucleotide
acgcagagcccgaaagcccccagt

SEQ ID NO: 3330 - DNA, 25 bp, Artificial Sequence
  Description of Artificial Sequence: Synthetic oligonucleotide
agggatcgcgggcgggtggcggcct

SEQ ID NO: 3331 - DNA, 23 bp, Artificial Sequence
  Description of Artificial Sequence: Synthetic oligonucleotide
atcgctgcggttgcgagcgctgt

SEQ ID NO: 3332 - DNA, 23 bp, Artificial Sequence
  Description of Artificial Sequence: Synthetic oligonucleotide
aaaatgcagattcctggactcca

SEQ ID NO: 3333 - DNA, 23 bp, Artificial Sequence
  Description of Artificial Sequence: Synthetic oligonucleotide
aaaatgcagattcctggactcca

SEQ ID NO: 3334 - DNA, 21 bp, Artificial Sequence
  Description of Artificial Sequence: Synthetic oligonucleotide
tggactgccctgatctggaga

SEQ ID NO: 3335 - DNA, 22 bp, Artificial Sequence
  Description of Artificial Sequence: Synthetic oligonucleotide
accaaagaccgcaattactttt

SEQ ID NO: 3336 - DNA, 22 bp, Artificial Sequence
  Description of Artificial Sequence: Synthetic oligonucleotide
caaagcgctcccctttagaggt

SEQ ID NO: 3337 - DNA, 22 bp, Artificial Sequence
  Description of Artificial Sequence: Synthetic oligonucleotide
tgaggtagtaggttgtatggtt

SEQ ID NO: 3338 - DNA, 22 bp, Artificial Sequence
  Description of Artificial Sequence: Synthetic oligonucleotide
tgaggtagtaggttgtatagtt

SEQ ID NO: 3339 - DNA, 22 bp, Artificial Sequence
  Description of Artificial Sequence: Synthetic oligonucleotide
aactatacaacctactacctca

SEQ ID NO: 3340 - DNA, 22 bp, Artificial Sequence
  Description of Artificial Sequence: Synthetic oligonucleotide
tgaggtagtaggttgtatagtt

SEQ ID NO: 3341 - DNA, 22 bp, Artificial Sequence
  Description of Artificial Sequence: Synthetic oligonucleotide
aactatacaatctactacctca

SEQ ID NO: 3342 - DNA, 22 bp, Artificial Sequence
  Description of Artificial Sequence: Synthetic oligonucleotide
tgaggtagtagattgtatagtt

SEQ ID NO: 3343 - DNA, 22 bp, Artificial Sequence
  Description of Artificial Sequence: Synthetic oligonucleotide
aactgtacaaactactacctca

SEQ ID NO: 3344 - DNA, 22 bp, Artificial Sequence
  Description of Artificial Sequence: Synthetic oligonucleotide
agaggtagtaggttgcatagtt

SEQ ID NO: 3345 - DNA, 22 bp, Artificial Sequence
  Description of Artificial Sequence: Synthetic oligonucleotide
tgaggtaggaggttgtatagtt

SEQ ID NO: 3346 - DNA, 18 bp, Artificial Sequence
  Description of Artificial Sequence: Synthetic oligonucleotide
tgcttcctttcagagggt

SEQ ID NO: 3347 - DNA, 18 bp, Artificial Sequence
  Description of Artificial Sequence: Synthetic oligonucleotide
tgcttcctttcagagggt

SEQ ID NO: 3348 - DNA, 22 bp, Artificial Sequence
  Description of Artificial Sequence: Synthetic oligonucleotide
tgaggtagtagtttgtgctgtt

SEQ ID NO: 3349 - DNA, 23 bp, Artificial Sequence
  Description of Artificial Sequence: Synthetic oligonucleotide
ctgcagaactgttcccgctgcta

SEQ ID NO: 3350 - DNA, 22 bp, Artificial Sequence
  Description of Artificial Sequence: Synthetic oligonucleotide
tgaaacatacacgggaaacctc

SEQ ID NO: 3351 - DNA, 22 bp, Artificial Sequence
  Description of Artificial Sequence: Synthetic oligonucleotide
aaagtgcatccttttagaggtt

SEQ ID NO: 3352 - DNA, 21 bp, Artificial Sequence
  Description of Artificial Sequence: Synthetic oligonucleotide
tggcagggaggctgggagggg

SEQ ID NO: 3353 - DNA, 22 bp, Artificial Sequence
  Description of Artificial Sequence: Synthetic oligonucleotide
ctatacaacctactgccttccc

SEQ ID NO: 3354 - DNA, 22 bp, Artificial Sequence
  Description of Artificial Sequence: Synthetic oligonucleotide
ggtacaatcaacggtcgatggt

SEQ ID NO: 3355 - DNA, 22 bp, Artificial Sequence
  Description of Artificial Sequence: Synthetic oligonucleotide
aaaaactgagactacttttgca

SEQ ID NO: 3356 - DNA, 22 bp, Artificial Sequence
  Description of Artificial Sequence: Synthetic oligonucleotide
tccctgagaccctaacttgtga

SEQ ID NO: 3357 - DNA, 22 bp, Artificial Sequence
  Description of Artificial Sequence: Synthetic oligonucleotide
tcacaagttagggtctcaggga

SEQ ID NO: 3358 - DNA, 22 bp, Artificial Sequence
  Description of Artificial Sequence: Synthetic oligonucleotide
actttcggttatctagctttat

SEQ ID NO: 3359 - DNA, 22 bp, Artificial Sequence
  Description of Artificial Sequence: Synthetic oligonucleotide
actttcggttatctagctttat

SEQ ID NO: 3360 - DNA, 22 bp, Artificial Sequence
  Description of Artificial Sequence: Synthetic oligonucleotide
ataaagctagataaccgaaagt

SEQ ID NO: 3361 - DNA, 23 bp, Artificial Sequence
  Description of Artificial Sequence: Synthetic oligonucleotide
cagtgcaatgatattgtcaaagc

SEQ ID NO: 3362 - DNA, 23 bp, Artificial Sequence
  Description of Artificial Sequence: Synthetic oligonucleotide
gctttgacaatactattgcactg

SEQ ID NO: 3363 - DNA, 22 bp, Artificial Sequence
  Description of Artificial Sequence: Synthetic oligonucleotide
aacaatacaacttactacctca

SEQ ID NO: 3364 - DNA, 22 bp, Artificial Sequence
  Description of Artificial Sequence: Synthetic oligonucleotide
tgtcttactccctcaggcacat

SEQ ID NO: 3365 - DNA, 22 bp, Artificial Sequence
  Description of Artificial Sequence: Synthetic oligonucleotide
tgtcttactccctcaggcacat

SEQ ID NO: 3366 - DNA, 22 bp, Artificial Sequence
  Description of Artificial Sequence: Synthetic oligonucleotide
acatcaatacttcctggctccc

SEQ ID NO: 3367 - DNA, 23 bp, Artificial Sequence
  Description of Artificial Sequence: Synthetic oligonucleotide
tccataaagtaggaaacactaca

SEQ ID NO: 3368 - DNA, 22 bp, Artificial Sequence
  Description of Artificial Sequence: Synthetic oligonucleotide
aatcatacagggacatccagtt

SEQ ID NO: 3369 - DNA, 23 bp, Artificial Sequence
  Description of Artificial Sequence: Synthetic oligonucleotide
ctacctgcacgaacagcactttg

SEQ ID NO: 3370 - DNA, 22 bp, Artificial Sequence
  Description of Artificial Sequence: Synthetic oligonucleotide
tgctcaataaatacccgttgaa

SEQ ID NO: 3371 - DNA, 23 bp, Artificial Sequence
  Description of Artificial Sequence: Synthetic oligonucleotide
agcaaaaatgtgctagtgccaaa

SEQ ID NO: 3372 - DNA, 22 bp, Artificial Sequence
  Description of Artificial Sequence: Synthetic oligonucleotide
cgtcttacccagcagtgtttgg

SEQ ID NO: 3373 - DNA, 20 bp, Artificial Sequence
  Description of Artificial Sequence: Synthetic oligonucleotide
ctgcaaagggaagccctttc

SEQ ID NO: 3374 - DNA, 22 bp, Artificial Sequence
  Description of Artificial Sequence: Synthetic oligonucleotide
aacgcacttccctttagagtgt

SEQ ID NO: 3375 - DNA, 22 bp, Artificial Sequence
  Description of Artificial Sequence: Synthetic oligonucleotide
aacgcacttccctttagagtgt

SEQ ID NO: 3376 - DNA, 22 bp, Artificial Sequence
  Description of Artificial Sequence: Synthetic oligonucleotide
tcggatccgtctgagcttggct

SEQ ID NO: 3377 - DNA, 23 bp, Artificial Sequence
  Description of Artificial Sequence: Synthetic oligonucleotide
gaacgcgcttccctatagagggt

SEQ ID NO: 3378 - DNA, 23 bp, Artificial Sequence
  Description of Artificial Sequence: Synthetic oligonucleotide
tcacataggaatgaaaagccata

SEQ ID NO: 3379 - DNA, 23 bp, Artificial Sequence
  Description of Artificial Sequence: Synthetic oligonucleotide
tcacataggaataaaaagccata

SEQ ID NO: 3380 - DNA, 23 bp, Artificial Sequence
  Description of Artificial Sequence: Synthetic oligonucleotide
tatggctttttattcctatgtga

SEQ ID NO: 3381 - DNA, 22 bp, Artificial Sequence
  Description of Artificial Sequence: Synthetic oligonucleotide
tgagaactgaattccataggct

SEQ ID NO: 3382 - DNA, 22 bp, Artificial Sequence
  Description of Artificial Sequence: Synthetic oligonucleotide
ctacccacagacgtaccaatca

SEQ ID NO: 3383 - DNA, 22 bp, Artificial Sequence
  Description of Artificial Sequence: Synthetic oligonucleotide
ctacccacagacgtaccaatca

SEQ ID NO: 3384 - DNA, 22 bp, Artificial Sequence
  Description of Artificial Sequence: Synthetic oligonucleotide
ctacccacagacgtaccaatca

SEQ ID NO: 3385 - DNA, 22 bp, Artificial Sequence
  Description of Artificial Sequence: Synthetic oligonucleotide
gggctgcactgccgaggcactg

SEQ ID NO: 3386 - DNA, 22 bp, Artificial Sequence
  Description of Artificial Sequence: Synthetic oligonucleotide
ctgttgccactaacctcaacct

SEQ ID NO: 3387 - DNA, 18 bp, Artificial Sequence
  Description of Artificial Sequence: Synthetic oligonucleotide
gtccctgttcaggcgcca

SEQ ID NO: 3388 - DNA, 22 bp, Artificial Sequence
  Description of Artificial Sequence: Synthetic oligonucleotide
catgccttgagtgtaggaccgt

SEQ ID NO: 3389 - DNA, 17 bp, Artificial Sequence
  Description of Artificial Sequence: Synthetic oligonucleotide
tggcgcccgaacaggga

SEQ ID NO: 3390 - DNA, 22 bp, Artificial Sequence
  Description of Artificial Sequence: Synthetic oligonucleotide
ctgcgcaagctactgccttgct

SEQ ID NO: 3391 - DNA, 22 bp, Artificial Sequence
  Description of Artificial Sequence: Synthetic oligonucleotide
cgaccatggctgtagactgtta

SEQ ID NO: 3392 - DNA, 22 bp, Artificial Sequence
  Description of Artificial Sequence: Synthetic oligonucleotide
actgcattatgagcacttaaag

SEQ ID NO: 3393 - DNA, 21 bp, Artificial Sequence
  Description of Artificial Sequence: Synthetic oligonucleotide
ggaaatccctggcaatgtgat

SEQ ID NO: 3394 - DNA, 21 bp, Artificial Sequence
  Description of Artificial Sequence: Synthetic oligonucleotide
atcacattgccagggattacc

SEQ ID NO: 3395 - DNA, 22 bp, Artificial Sequence
  Description of Artificial Sequence: Synthetic oligonucleotide
tttcagttatcaatctgtcaca

SEQ ID NO: 3396 - DNA, 22 bp, Artificial Sequence
  Description of Artificial Sequence: Synthetic oligonucleotide
tcagtgcatcacagaactttgt

SEQ ID NO: 3397 - DNA, 22 bp, Artificial Sequence
  Description of Artificial Sequence: Synthetic oligonucleotide
acaaagttctgtagtgcactga

SEQ ID NO: 3398 - DNA, 21 bp, Artificial Sequence
  Description of Artificial Sequence: Synthetic oligonucleotide
aagggtcagtaagcacccgcg

SEQ ID NO: 3399 - DNA, 22 bp, Artificial Sequence
  Description of Artificial Sequence: Synthetic oligonucleotide
ctgttcctgctgaactgagcca

SEQ ID NO: 3400 - DNA, 22 bp, Artificial Sequence
  Description of Artificial Sequence: Synthetic oligonucleotide
tggctcagttcagcaggaacag

SEQ ID NO: 3401 - DNA, 22 bp, Artificial Sequence
  Description of Artificial Sequence: Synthetic oligonucleotide
gcctaagacacaggcccagaga

SEQ ID NO: 3402 - DNA, 22 bp, Artificial Sequence
  Description of Artificial Sequence: Synthetic oligonucleotide
tctaacaccacagtgtggtttg

SEQ ID NO: 3403 - DNA, 22 bp, Artificial Sequence
  Description of Artificial Sequence: Synthetic oligonucleotide
aactcagtaatggtaacggttt

SEQ ID NO: 3404 - DNA, 22 bp, Artificial Sequence
  Description of Artificial Sequence: Synthetic oligonucleotide
tcagtttcctctgcaaacagtt

SEQ ID NO: 3405 - DNA, 22 bp, Artificial Sequence
  Description of Artificial Sequence: Synthetic oligonucleotide
gctataaagtaactgagacgga

SEQ ID NO: 3406 - DNA, 23 bp, Artificial Sequence
  Description of Artificial Sequence: Synthetic oligonucleotide
accctataagcaatattgcacta

SEQ ID NO: 3407 - DNA, 21 bp, Artificial Sequence
  Description of Artificial Sequence: Synthetic oligonucleotide
caactgatgcctttccaagta

SEQ ID NO: 3408 - DNA, 22 bp, Artificial Sequence
  Description of Artificial Sequence: Synthetic oligonucleotide
cccatggcttttagccctacat

SEQ ID NO: 3409 - DNA, 21 bp, Artificial Sequence
  Description of Artificial Sequence: Synthetic oligonucleotide
cacaacctcagtgtttccagg

SEQ ID NO: 3410 - DNA, 25 bp, Artificial Sequence
  Description of Artificial Sequence: Synthetic oligonucleotide
aaaggattctgctgtcggtcccact

SEQ ID NO: 3411 - DNA, 22 bp, Artificial Sequence
  Description of Artificial Sequence: Synthetic oligonucleotide
gaaacaagtaatcaagaatagg

SEQ ID NO: 3412 - DNA, 22 bp, Artificial Sequence
  Description of Artificial Sequence: Synthetic oligonucleotide
cagcaggtacccccatgttaaa

SEQ ID NO: 3413 - DNA, 22 bp, Artificial Sequence
  Description of Artificial Sequence: Synthetic oligonucleotide
tatccactacaccccgctgcct

SEQ ID NO: 3414 - DNA, 22 bp, Artificial Sequence
  Description of Artificial Sequence: Synthetic oligonucleotide
tatggatgcaaaatgatcccaa

SEQ ID NO: 3415 - DNA, 21 bp, Artificial Sequence
  Description of Artificial Sequence: Synthetic oligonucleotide
acaggattgagggggggccct

SEQ ID NO: 3416 - DNA, 22 bp, Artificial Sequence
  Description of Artificial Sequence: Synthetic oligonucleotide
aaatctacattgtatgccaggt

SEQ ID NO: 3417 - DNA, 22 bp, Artificial Sequence
  Description of Artificial Sequence: Synthetic oligonucleotide
catacctatagatacaagcttg

SEQ ID NO: 3418 - DNA, 22 bp, Artificial Sequence
  Description of Artificial Sequence: Synthetic oligonucleotide
gaaagcacttccatgttaaagt

SEQ ID NO: 3419 - DNA, 22 bp, Artificial Sequence
  Description of Artificial Sequence: Synthetic oligonucleotide
aatcgtacagggtcatccactt

SEQ ID NO: 3420 - DNA, 21 bp, Artificial Sequence
  Description of Artificial Sequence: Synthetic oligonucleotide
gttatagatctggatttgaac

SEQ ID NO: 3421 - DNA, 22 bp, Artificial Sequence
  Description of Artificial Sequence: Synthetic oligonucleotide
gactatagaactttccccctca

SEQ ID NO: 3422 - DNA, 22 bp, Artificial Sequence
  Description of Artificial Sequence: Synthetic oligonucleotide
tgagggggaaagttctatagtc

SEQ ID NO: 3423 - DNA, 22 bp, Artificial Sequence
  Description of Artificial Sequence: Synthetic oligonucleotide
catcttccagtacagtgttgga

SEQ ID NO: 3424 - DNA, 21 bp, Artificial Sequence
  Description of Artificial Sequence: Synthetic oligonucleotide
aaactactgaaaatcaaagat

SEQ ID NO: 3425 - DNA, 22 bp, Artificial Sequence
  Description of Artificial Sequence: Synthetic oligonucleotide
ctcctacatattagcattaaca

SEQ ID NO: 3426 - DNA, 22 bp, Artificial Sequence
  Description of Artificial Sequence: Synthetic oligonucleotide
tgagaactgaattccatgggtt

SEQ ID NO: 3427 - DNA, 27 bp, Artificial Sequence
  Description of Artificial Sequence: Synthetic oligonucleotide
cactgtaggtgatggtgagagtgggca

SEQ ID NO: 3428 - DNA, 22 bp, Artificial Sequence
  Description of Artificial Sequence: Synthetic oligonucleotide
tgaggtagtaggttgtatagtt

SEQ ID NO: 3429 - DNA, 22 bp, Artificial Sequence
  Description of Artificial Sequence: Synthetic oligonucleotide
tgaggtagtaggttgtatagtt

SEQ ID NO: 3430 - DNA, 22 bp, Artificial Sequence
  Description of Artificial Sequence: Synthetic oligonucleotide
tgaggtagtaggttgtgtggtt

SEQ ID NO: 3431 - DNA, 22 bp, Artificial Sequence
  Description of Artificial Sequence: Synthetic oligonucleotide
agaggtagtaggttgcatagtt

SEQ ID NO: 3432 - DNA, 22 bp, Artificial Sequence
  Description of Artificial Sequence: Synthetic oligonucleotide
tgaggtaggaggttgtatagtt

SEQ ID NO: 3433 - DNA, 22 bp, Artificial Sequence
  Description of Artificial Sequence: Synthetic oligonucleotide
tgaggtagtagattgtatagtt

SEQ ID NO: 3434 - DNA, 22 bp, Artificial Sequence
  Description of Artificial Sequence: Synthetic oligonucleotide
tgaggtagtagtttgtacagtt

SEQ ID NO: 3435 - DNA, 22 bp, Artificial Sequence
  Description of Artificial Sequence: Synthetic oligonucleotide
tgaggtagtagtttgtgctgtt

SEQ ID NO: 3436 - DNA, 22 bp, Artificial Sequence
  Description of Artificial Sequence: Synthetic oligonucleotide
tacagtactgtgataactgaag

SEQ ID NO: 3437 - DNA, 22 bp, Artificial Sequence
  Description of Artificial Sequence: Synthetic oligonucleotide
tacagtactgtgataactgaag

SEQ ID NO: 3438 - DNA, 23 bp, Artificial Sequence
  Description of Artificial Sequence: Synthetic oligonucleotide
agcagcattgtacagggctatga

SEQ ID NO: 3439 - DNA, 20 bp, Artificial Sequence
  Description of Artificial Sequence: Synthetic oligonucleotide
ccgcactgtgggtacttgct

SEQ ID NO: 3440 - DNA, 21 bp, Artificial Sequence
  Description of Artificial Sequence: Synthetic oligonucleotide
taaagtgctgacagtgcagat

SEQ ID NO: 3441 - DNA, 24 bp, Artificial Sequence
  Description of Artificial Sequence: Synthetic oligonucleotide
tccctgagaccctttaacctgtga

SEQ ID NO: 3442 - DNA, 22 bp, Artificial Sequence
  Description of Artificial Sequence: Synthetic oligonucleotide
tccctgagaccctaacttgtga

SEQ ID NO: 3443 - DNA, 18 bp, Artificial Sequence
  Description of Artificial Sequence: Synthetic oligonucleotide
gtccctgttcgggcgcca

SEQ ID NO: 3444 - DNA, 18 bp, Artificial Sequence
  Description of Artificial Sequence: Synthetic oligonucleotide
gtccctgttcgggcgcca

SEQ ID NO: 3445 - DNA, 17 bp, Artificial Sequence
  Description of Artificial Sequence: Synthetic oligonucleotide
gtgggggagaggctgta

SEQ ID NO: 3446 - DNA, 17 bp, Artificial Sequence
  Description of Artificial Sequence: Synthetic oligonucleotide
tcccaccgctgccacca

SEQ ID NO: 3447 - DNA, 17 bp, Artificial Sequence
  Description of Artificial Sequence: Synthetic oligonucleotide
tcccaccgctgccacca

SEQ ID NO: 3448 - DNA, 17 bp, Artificial Sequence
  Description of Artificial Sequence: Synthetic oligonucleotide
tcccaccgctgccacca

SEQ ID NO: 3449 - DNA, 17 bp, Artificial Sequence
  Description of Artificial Sequence: Synthetic oligonucleotide
tcccaccgctgccacca

SEQ ID NO: 3450 - DNA, 17 bp, Artificial Sequence
  Description of Artificial Sequence: Synthetic oligonucleotide
tcccaccgctgccacca

SEQ ID NO: 3451 - DNA, 17 bp, Artificial Sequence
  Description of Artificial Sequence: Synthetic oligonucleotide
tcccaccgctgccacca

SEQ ID NO: 3452 - DNA, 17 bp, Artificial Sequence
  Description of Artificial Sequence: Synthetic oligonucleotide
tcccaccgctgccacca

SEQ ID NO: 3453 - DNA, 21 bp, Artificial Sequence
  Description of Artificial Sequence: Synthetic oligonucleotide
tcacagtgaaccggtctcttt

SEQ ID NO: 3454 - DNA, 23 bp, Artificial Sequence
  Description of Artificial Sequence: Synthetic oligonucleotide
gcatgggtggttcagtggtagaa

SEQ ID NO: 3455 - DNA, 23 bp, Artificial Sequence
  Description of Artificial Sequence: Synthetic oligonucleotide
gcatgggtggttcagtggtagaa

SEQ ID NO: 3456 - DNA, 23 bp, Artificial Sequence
  Description of Artificial Sequence: Synthetic oligonucleotide
gcatgggtggttcagtggtagaa

SEQ ID NO: 3457 - DNA, 23 bp, Artificial Sequence
  Description of Artificial Sequence: Synthetic oligonucleotide
gcatgggtggttcagtggtagaa

SEQ ID NO: 3458 - DNA, 23 bp, Artificial Sequence
  Description of Artificial Sequence: Synthetic oligonucleotide
gcatgggtggttcagtggtagaa

SEQ ID NO: 3459 - DNA, 22 bp, Artificial Sequence
  Description of Artificial Sequence: Synthetic oligonucleotide
cagtgcaatgatgaaagggcat

SEQ ID NO: 3460 - DNA, 24 bp, Artificial Sequence
  Description of Artificial Sequence: Synthetic oligonucleotide
agctggtgttgtgaatcaggccgt

SEQ ID NO: 3461 - DNA, 22 bp, Artificial Sequence
  Description of Artificial Sequence: Synthetic oligonucleotide
taccacagggtagaaccacgga

SEQ ID NO: 3462 - DNA, 21 bp, Artificial Sequence
  Description of Artificial Sequence: Synthetic oligonucleotide
cagtggttttaccctatggta

SEQ ID NO: 3463 - DNA, 23 bp, Artificial Sequence
  Description of Artificial Sequence: Synthetic oligonucleotide
tgtagtgtttcctactttatgga

SEQ ID NO: 3464 - DNA, 22 bp, Artificial Sequence
  Description of Artificial Sequence: Synthetic oligonucleotide
tgagaactgaattccatgggtt

SEQ ID NO: 3465 - DNA, 24 bp, Artificial Sequence
  Description of Artificial Sequence: Synthetic oligonucleotide
tgagaactgaattccataggctgt

SEQ ID NO: 3466 - DNA, 21 bp, Artificial Sequence
  Description of Artificial Sequence: Synthetic oligonucleotide
tctcccaacccttgtaccagt

SEQ ID NO: 3467 - DNA, 21 bp, Artificial Sequence
  Description of Artificial Sequence: Synthetic oligonucleotide
ctagactgaagctccttgagg

SEQ ID NO: 3468 - DNA, 21 bp, Artificial Sequence
  Description of Artificial Sequence: Synthetic oligonucleotide
ctagactgaagctccttgagg

SEQ ID NO: 3469 - DNA, 22 bp, Artificial Sequence
  Description of Artificial Sequence: Synthetic oligonucleotide
tcgaggagctcacagtctagta

SEQ ID NO: 3470 - DNA, 22 bp, Artificial Sequence
  Description of Artificial Sequence: Synthetic oligonucleotide
tcgaggagctcacagtctagta

SEQ ID NO: 3471 - DNA, 23 bp, Artificial Sequence
  Description of Artificial Sequence: Synthetic oligonucleotide
ttaatgctaatcgtgataggggt

SEQ ID NO: 3472 - DNA, 21 bp, Artificial Sequence
  Description of Artificial Sequence: Synthetic oligonucleotide
tagcagcacataatggtttgt

SEQ ID NO: 3473 - DNA, 21 bp, Artificial Sequence
  Description of Artificial Sequence: Synthetic oligonucleotide
tagcagcacataatggtttgt

SEQ ID NO: 3474 - DNA, 21 bp, Artificial Sequence
  Description of Artificial Sequence: Synthetic oligonucleotide
cgaatcattatttgctgctct

SEQ ID NO: 3475 - DNA, 22 bp, Artificial Sequence
  Description of Artificial Sequence: Synthetic oligonucleotide
tagcagcacatcatggtttaca

SEQ ID NO: 3476 - DNA, 22 bp, Artificial Sequence
  Description of Artificial Sequence: Synthetic oligonucleotide
tagcagcacgtaaatattggcg

SEQ ID NO: 3477 - DNA, 22 bp, Artificial Sequence
  Description of Artificial Sequence: Synthetic oligonucleotide
tagcagcacgtaaatattggcg

SEQ ID NO: 3478 - DNA, 22 bp, Artificial Sequence
  Description of Artificial Sequence: Synthetic oligonucleotide
actgcagtgaaggcacttgtag

SEQ ID NO: 3479 - DNA, 23 bp, Artificial Sequence
  Description of Artificial Sequence: Synthetic oligonucleotide
caaagtgcttacagtgcaggtag

SEQ ID NO: 3480 - DNA, 20 bp, Artificial Sequence
  Description of Artificial Sequence: Synthetic oligonucleotide
accatcgaccgttgattgta

SEQ ID NO: 3481 - DNA, 24 bp, Artificial Sequence
  Description of Artificial Sequence: Synthetic oligonucleotide
aacattcaacgctgtcggtgagtt

SEQ ID NO: 3482 - DNA, 24 bp, Artificial Sequence
  Description of Artificial Sequence: Synthetic oligonucleotide
aacattcaacgctgtcggtgagtt

SEQ ID NO: 3483 - DNA, 22 bp, Artificial Sequence
  Description of Artificial Sequence: Synthetic oligonucleotide
actgccctaagtgctccttctg

SEQ ID NO: 3484 - DNA, 22 bp, Artificial Sequence
  Description of Artificial Sequence: Synthetic oligonucleotide
taaggtgcatctagtgcagata

SEQ ID NO: 3485 - DNA, 23 bp, Artificial Sequence
  Description of Artificial Sequence: Synthetic oligonucleotide
caacggaatcccaaaagcagctg

SEQ ID NO: 3486 - DNA, 20 bp, Artificial Sequence
  Description of Artificial Sequence: Synthetic oligonucleotide
ctgacctatgaattgacagc

SEQ ID NO: 3487 - DNA, 22 bp, Artificial Sequence
  Description of Artificial Sequence: Synthetic oligonucleotide
aactggccctcaaagtcccgct

SEQ ID NO: 3488 - DNA, 22 bp, Artificial Sequence
  Description of Artificial Sequence: Synthetic oligonucleotide
tagcagcacagaaatattggca

SEQ ID NO: 3489 - DNA, 21 bp, Artificial Sequence
  Description of Artificial Sequence: Synthetic oligonucleotide
ttcaccaccttctccacccag

SEQ ID NO: 3490 - DNA, 23 bp, Artificial Sequence
  Description of Artificial Sequence: Synthetic oligonucleotide
cccagtgttcagactacctgttc

SEQ ID NO: 3491 - DNA, 23 bp, Artificial Sequence
  Description of Artificial Sequence: Synthetic oligonucleotide
cccagtgttcagactacctgttc

SEQ ID NO: 3492 - DNA, 21 bp, Artificial Sequence
  Description of Artificial Sequence: Synthetic oligonucleotide
acagtagtctgcacattggtt

SEQ ID NO: 3493 - DNA, 21 bp, Artificial Sequence
  Description of Artificial Sequence: Synthetic oligonucleotide
acagtagtctgcacattggtt

SEQ ID NO: 3494 - DNA, 21 bp, Artificial Sequence
  Description of Artificial Sequence: Synthetic oligonucleotide
acagtagtctgcacattggtt

SEQ ID NO: 3495 - DNA, 23 bp, Artificial Sequence
  Description of Artificial Sequence: Synthetic oligonucleotide
tgtgcaaatctatgcaaaactga

SEQ ID NO: 3496 - DNA, 23 bp, Artificial Sequence
  Description of Artificial Sequence: Synthetic oligonucleotide
tgtgcaaatccatgcaaaactga

SEQ ID NO: 3497 - DNA, 23 bp, Artificial Sequence
  Description of Artificial Sequence: Synthetic oligonucleotide
tgtgcaaatccatgcaaaactga

SEQ ID NO: 3498 - DNA, 23 bp, Artificial Sequence
  Description of Artificial Sequence: Synthetic oligonucleotide
taaagtgcttatagtgcaggtag

SEQ ID NO: 3499 - DNA, 23 bp, Artificial Sequence
  Description of Artificial Sequence: Synthetic oligonucleotide
caaagtgcttatagtgcaggtag

SEQ ID NO: 3500 - DNA, 22 bp, Artificial Sequence
  Description of Artificial Sequence: Synthetic oligonucleotide
tagcttatcagactgatgttga

SEQ ID NO: 3501 - DNA, 24 bp, Artificial Sequence
  Description of Artificial Sequence: Synthetic oligonucleotide
aatgacacgatcactcccgttgag

SEQ ID NO: 3502 - DNA, 21 bp, Artificial Sequence
  Description of Artificial Sequence: Synthetic oligonucleotide
agctacattgtctgctgggtt

SEQ ID NO: 3503 - DNA, 23 bp, Artificial Sequence
  Description of Artificial Sequence: Synthetic oligonucleotide
agctacatctggctactgggtct

SEQ ID NO: 3504 - DNA, 22 bp, Artificial Sequence
  Description of Artificial Sequence: Synthetic oligonucleotide
tgtcagtttgtcaaatacccca

SEQ ID NO: 3505 - DNA, 22 bp, Artificial Sequence
  Description of Artificial Sequence: Synthetic oligonucleotide
atcacattgccagggatttcca

SEQ ID NO: 3506 - DNA, 22 bp, Artificial Sequence
  Description of Artificial Sequence: Synthetic oligonucleotide
atcacattgccagggattacca

SEQ ID NO: 3507 - DNA, 22 bp, Artificial Sequence
  Description of Artificial Sequence: Synthetic oligonucleotide
cattgcacttgtctcggtctga

SEQ ID NO: 3508 - DNA, 22 bp, Artificial Sequence
  Description of Artificial Sequence: Synthetic oligonucleotide
ttcaagtaatccaggataggct

SEQ ID NO: 3509 - DNA, 22 bp, Artificial Sequence
  Description of Artificial Sequence: Synthetic oligonucleotide
ttcaagtaatccaggataggct

SEQ ID NO: 3510 - DNA, 22 bp, Artificial Sequence
  Description of Artificial Sequence: Synthetic oligonucleotide
ttcaagtaattcaggataggtt

SEQ ID NO: 3511 - DNA, 20 bp, Artificial Sequence
  Description of Artificial Sequence: Synthetic oligonucleotide
ttcacagtggctaagttctg

SEQ ID NO: 3512 - DNA, 22 bp, Artificial Sequence
  Description of Artificial Sequence: Synthetic oligonucleotide
cactagattgtgagctcctgga

SEQ ID NO: 3513 - DNA, 22 bp, Artificial Sequence
  Description of Artificial Sequence: Synthetic oligonucleotide
aaggagctcacagtctattgag

SEQ ID NO: 3514 - DNA, 22 bp, Artificial Sequence
  Description of Artificial Sequence: Synthetic oligonucleotide
tagcaccatctgaaatcggtta

SEQ ID NO: 3515 - DNA, 23 bp, Artificial Sequence
  Description of Artificial Sequence: Synthetic oligonucleotide
tagcaccatttgaaatcagtgtt

SEQ ID NO: 3516 - DNA, 21 bp, Artificial Sequence
  Description of Artificial Sequence: Synthetic oligonucleotide
tgaccgatttctcctggtgtt

SEQ ID NO: 3517 - DNA, 22 bp, Artificial Sequence
  Description of Artificial Sequence: Synthetic oligonucleotide
tagcaccatttgaaatcggtta

SEQ ID NO: 3518 - DNA, 20 bp, Artificial Sequence
  Description of Artificial Sequence: Synthetic oligonucleotide
tgtaaacatcctcgactgga

SEQ ID NO: 3519 - DNA, 22 bp, Artificial Sequence
  Description of Artificial Sequence: Synthetic oligonucleotide
tgtaaacatcctacactcagct

SEQ ID NO: 3520 - DNA, 23 bp, Artificial Sequence
  Description of Artificial Sequence: Synthetic oligonucleotide
tgtaaacatcctacactctcagc

SEQ ID NO: 3521 - DNA, 22 bp, Artificial Sequence
  Description of Artificial Sequence: Synthetic oligonucleotide
tgtaaacatccccgactggaag

SEQ ID NO: 3522 - DNA, 24 bp, Artificial Sequence
  Description of Artificial Sequence: Synthetic oligonucleotide
tgtaaacatccttgactggaagct

SEQ ID NO: 3523 - DNA, 16 bp, Artificial Sequence
  Description of Artificial Sequence: Synthetic oligonucleotide
tgggttgagagggcga

SEQ ID NO: 3524 - DNA, 18 bp, Artificial Sequence
  Description of Artificial Sequence: Synthetic oligonucleotide
ctggccctctctgccctt

SEQ ID NO: 3525 - DNA, 21 bp, Artificial Sequence
  Description of Artificial Sequence: Synthetic oligonucleotide
gcccctgggcctatcctagaa

SEQ ID NO: 3526 - DNA, 20 bp, Artificial Sequence
  Description of Artificial Sequence: Synthetic oligonucleotide
tccctgtcctccaggagctc

SEQ ID NO: 3527 - DNA, 20 bp, Artificial Sequence
  Description of Artificial Sequence: Synthetic oligonucleotide
tccctgtcctccaggagctc

SEQ ID NO: 3528 - DNA, 24 bp, Artificial Sequence
  Description of Artificial Sequence: Synthetic oligonucleotide
tctcacacagaaatcgcacccgtc

SEQ ID NO: 3529 - DNA, 20 bp, Artificial Sequence
  Description of Artificial Sequence: Synthetic oligonucleotide
ggggtgctatctgtgattga

SEQ ID NO: 3530 - DNA, 23 bp, Artificial Sequence
  Description of Artificial Sequence: Synthetic oligonucleotide
tggcagtgtcttagctggttgtt

SEQ ID NO: 3531 - DNA, 22 bp, Artificial Sequence
  Description of Artificial Sequence: Synthetic oligonucleotide
tcccccaggtgtgattctgatt

SEQ ID NO: 3532 - DNA, 22 bp, Artificial Sequence
  Description of Artificial Sequence: Synthetic oligonucleotide
taatgcccctaaaaatccttat

SEQ ID NO: 3533 - DNA, 22 bp, Artificial Sequence
  Description of Artificial Sequence: Synthetic oligonucleotide
taatgcccctaaaaatccttat

SEQ ID NO: 3534 - DNA, 21 bp, Artificial Sequence
  Description of Artificial Sequence: Synthetic oligonucleotide
ctcctgactccaggtcctgtg

SEQ ID NO: 3535 - DNA, 22 bp, Artificial Sequence
  Description of Artificial Sequence: Synthetic oligonucleotide
agctcggtctgaggcccctcag

SEQ ID NO: 3536 - DNA, 22 bp, Artificial Sequence
  Description of Artificial Sequence: Synthetic oligonucleotide
tgaggggcagagagcgagactt

SEQ ID NO: 3537 - DNA, 22 bp, Artificial Sequence
  Description of Artificial Sequence: Synthetic oligonucleotide
tcctgtactgagctgccccgag

SEQ ID NO: 3538 - DNA, 21 bp, Artificial Sequence
  Description of Artificial Sequence: Synthetic oligonucleotide
cagcagcacactgtggtttgt

SEQ ID NO: 3539 - DNA, 18 bp, Artificial Sequence
  Description of Artificial Sequence: Synthetic oligonucleotide
cgtcaacacttgctggtt

SEQ ID NO: 3540 - DNA, 21 bp, Artificial Sequence
  Description of Artificial Sequence: Synthetic oligonucleotide
cacgctcatgcacacacccac

SEQ ID NO: 3541 - DNA, 20 bp, Artificial Sequence
  Description of Artificial Sequence: Synthetic oligonucleotide
agggggaaagttctatagtc

SEQ ID NO: 3542 - DNA, 20 bp, Artificial Sequence
  Description of Artificial Sequence: Synthetic oligonucleotide
agggggaaagttctatagtc

SEQ ID NO: 3543 - DNA, 21 bp, Artificial Sequence
  Description of Artificial Sequence: Synthetic oligonucleotide
tgggtttacgttgggagaact

SEQ ID NO: 3544 - DNA, 21 bp, Artificial Sequence
  Description of Artificial Sequence: Synthetic oligonucleotide
caacaaatcacagtctgccat

SEQ ID NO: 3545 - DNA, 23 bp, Artificial Sequence
  Description of Artificial Sequence: Synthetic oligonucleotide
tggaagactagtgattttgttgt

SEQ ID NO: 3546 - DNA, 23 bp, Artificial Sequence
  Description of Artificial Sequence: Synthetic oligonucleotide
tggaagactagtgattttgttgt

SEQ ID NO: 3547 - DNA, 23 bp, Artificial Sequence
  Description of Artificial Sequence: Synthetic oligonucleotide
tggaagactagtgattttgttgt

SEQ ID NO: 3548 - DNA, 23 bp, Artificial Sequence
  Description of Artificial Sequence: Synthetic oligonucleotide
aggttgggatcggttgcaatgct

SEQ ID NO: 3549 - DNA, 22 bp, Artificial Sequence
  Description of Artificial Sequence: Synthetic oligonucleotide
tattgcacttgtcccggcctgt

SEQ ID NO: 3550 - DNA, 22 bp, Artificial Sequence
  Description of Artificial Sequence: Synthetic oligonucleotide
tattgcacttgtcccggcctgt

SEQ ID NO: 3551 - DNA, 19 bp, Artificial Sequence
  Description of Artificial Sequence: Synthetic oligonucleotide
tattgcactcgtcccggcc

SEQ ID NO: 3552 - DNA, 23 bp, Artificial Sequence
  Description of Artificial Sequence: Synthetic oligonucleotide
caaagtgctgttcgtgcaggtag

SEQ ID NO: 3553 - DNA, 22 bp, Artificial Sequence
  Description of Artificial Sequence: Synthetic oligonucleotide
tgaggtagtaagttgtattgtt

SEQ ID NO: 3554 - DNA, 21 bp, Artificial Sequence
  Description of Artificial Sequence: Synthetic oligonucleotide
cccataaagtagaaagcacta

SEQ ID NO: 3555 - DNA, 21 bp, Artificial Sequence
  Description of Artificial Sequence: Synthetic oligonucleotide
accaatattactgtgctgctt

SEQ ID NO: 3556 - DNA, 23 bp, Artificial Sequence
  Description of Artificial Sequence: Synthetic oligonucleotide
acattcattgctgtcggtgggtt

SEQ ID NO: 3557 - DNA, 23 bp, Artificial Sequence
  Description of Artificial Sequence: Synthetic oligonucleotide
acattcattgctgtcggtgggtt

SEQ ID NO: 3558 - DNA, 18 bp, Artificial Sequence
  Description of Artificial Sequence: Synthetic oligonucleotide
tgaggtagtaggttgtat

SEQ ID NO: 3559 - DNA, 21 bp, Artificial Sequence
  Description of Artificial Sequence: Synthetic oligonucleotide
ctatacgacctgctgcctttc

SEQ ID NO: 3560 - DNA, 22 bp, Artificial Sequence
  Description of Artificial Sequence: Synthetic oligonucleotide
catcgggaatgtcgtgtccgcc

SEQ ID NO: 3561 - DNA, 17 bp, Artificial Sequence
  Description of Artificial Sequence: Synthetic oligonucleotide
cccgggtttcggcacca

SEQ ID NO: 3562 - DNA, 17 bp, Artificial Sequence
  Description of Artificial Sequence: Synthetic oligonucleotide
cccgggtttcggcacca

SEQ ID NO: 3563 - DNA, 20 bp, Artificial Sequence
  Description of Artificial Sequence: Synthetic oligonucleotide
gccgggtactttcgtatttt

SEQ ID NO: 3564 - DNA, 26 bp, Artificial Sequence
  Description of Artificial Sequence: Synthetic oligonucleotide
gctaaggaagtcctgtgctcagtttt

SEQ ID NO: 3565 - DNA, 22 bp, Artificial Sequence
  Description of Artificial Sequence: Synthetic oligonucleotide
tcgattcccggcccatgcacca

SEQ ID NO: 3566 - DNA, 22 bp, Artificial Sequence
  Description of Artificial Sequence: Synthetic oligonucleotide
tcgattcccggcccatgcacca

SEQ ID NO: 3567 - DNA, 22 bp, Artificial Sequence
  Description of Artificial Sequence: Synthetic oligonucleotide
tcgattcccggcccatgcacca

SEQ ID NO: 3568 - DNA, 22 bp, Artificial Sequence
  Description of Artificial Sequence: Synthetic oligonucleotide
tcgattcccggcccatgcacca

SEQ ID NO: 3569 - DNA, 22 bp, Artificial Sequence
  Description of Artificial Sequence: Synthetic oligonucleotide
tcgattcccggcccatgcacca

SEQ ID NO: 3570 - DNA, 22 bp, Artificial Sequence
  Description of Artificial Sequence: Synthetic oligonucleotide
tcgattcccggcccatgcacca

SEQ ID NO: 3571 - DNA, 17 bp, Artificial Sequence
  Description of Artificial Sequence: Synthetic oligonucleotide
agaaaggccgaatttta

SEQ ID NO: 3572 - DNA, 19 bp, Artificial Sequence
  Description of Artificial Sequence: Synthetic oligonucleotide
tggtgtggtctgttgtttt

SEQ ID NO: 3573 - DNA, 27 bp, Artificial Sequence
  Description of Artificial Sequence: Synthetic oligonucleotide
ccccccactgctaaatttgactggctt

SEQ ID NO: 3574 - DNA, 27 bp, Artificial Sequence
  Description of Artificial Sequence: Synthetic oligonucleotide
ccccccactgctaaatttgactggctt

SEQ ID NO: 3575 - DNA, 17 bp, Artificial Sequence
  Description of Artificial Sequence: Synthetic oligonucleotide
tccccgcacctccacca

SEQ ID NO: 3576 - DNA, 17 bp, Artificial Sequence
  Description of Artificial Sequence: Synthetic oligonucleotide
gagagcgctcggttttt

SEQ ID NO: 3577 - DNA, 18 bp, Artificial Sequence
  Description of Artificial Sequence: Synthetic oligonucleotide
atcccactcctgacacca

SEQ ID NO: 3578 - DNA, 19 bp, Artificial Sequence
  Description of Artificial Sequence: Synthetic oligonucleotide
ggcgtgattcatacctttt

SEQ ID NO: 3579 - DNA, 17 bp, Artificial Sequence
  Description of Artificial Sequence: Synthetic oligonucleotide
agggtgtgcgtgttttt

SEQ ID NO: 3580 - DNA, 28 bp, Artificial Sequence
  Description of Artificial Sequence: Synthetic oligonucleotide
aaccgagcgtccaagctctttccatttt

SEQ ID NO: 3581 - DNA, 18 bp, Artificial Sequence
  Description of Artificial Sequence: Synthetic oligonucleotide
tccccgacacctccacca

SEQ ID NO: 3582 - DNA, 17 bp, Artificial Sequence
  Description of Artificial Sequence: Synthetic oligonucleotide
gcccgcatcctccacca

SEQ ID NO: 3583 - DNA, 18 bp, Artificial Sequence
  Description of Artificial Sequence: Synthetic oligonucleotide
atgtggtggcttactttt

SEQ ID NO: 3584 - DNA, 18 bp, Artificial Sequence
  Description of Artificial Sequence: Synthetic oligonucleotide
tccccggcacttccacca

SEQ ID NO: 3585 - DNA, 17 bp, Artificial Sequence
  Description of Artificial Sequence: Synthetic oligonucleotide
tcaccccataaacacca

SEQ ID NO: 3586 - DNA, 18 bp, Artificial Sequence
  Description of Artificial Sequence: Synthetic oligonucleotide
ttccccgacggggagcca

SEQ ID NO: 3587 - DNA, 18 bp, Artificial Sequence
  Description of Artificial Sequence: Synthetic oligonucleotide
ttccccgacggggagcca

SEQ ID NO: 3588 - DNA, 18 bp, Artificial Sequence
  Description of Artificial Sequence: Synthetic oligonucleotide
ttccccgacggggagcca

SEQ ID NO: 3589 - DNA, 18 bp, Artificial Sequence
  Description of Artificial Sequence: Synthetic oligonucleotide
ttccccgacggggagcca

SEQ ID NO: 3590 - DNA, 18 bp, Artificial Sequence
  Description of Artificial Sequence: Synthetic oligonucleotide
ttccccgacggggagcca

SEQ ID NO: 3591 - DNA, 23 bp, Artificial Sequence
  Description of Artificial Sequence: Synthetic oligonucleotide
tgtgctccggagttacctcgttt

SEQ ID NO: 3592 - DNA, 17 bp, Artificial Sequence
  Description of Artificial Sequence: Synthetic oligonucleotide
tcacgtcggggtcacca

SEQ ID NO: 3593 - DNA, 19 bp, Artificial Sequence
  Description of Artificial Sequence: Synthetic oligonucleotide
agtcccatctgggtcgcca

SEQ ID NO: 3594 - DNA, 19 bp, Artificial Sequence
  Description of Artificial Sequence: Synthetic oligonucleotide
agtcccatctgggtcgcca

SEQ ID NO: 3595 - DNA, 19 bp, Artificial Sequence
  Description of Artificial Sequence: Synthetic oligonucleotide
agtcccatctgggtcgcca

SEQ ID NO: 3596 - DNA, 19 bp, Artificial Sequence
  Description of Artificial Sequence: Synthetic oligonucleotide
agtcccatctgggtcgcca

SEQ ID NO: 3597 - DNA, 19 bp, Artificial Sequence
  Description of Artificial Sequence: Synthetic oligonucleotide
agtcccatctgggtcgcca

SEQ ID NO: 3598 - DNA, 19 bp, Artificial Sequence
  Description of Artificial Sequence: Synthetic oligonucleotide
agtcccatctgggtcgcca

SEQ ID NO: 3599 - DNA, 19 bp, Artificial Sequence
  Description of Artificial Sequence: Synthetic oligonucleotide
agtcccatctgggtcgcca

SEQ ID NO: 3600 - DNA, 19 bp, Artificial Sequence
  Description of Artificial Sequence: Synthetic oligonucleotide
agtcccatctgggtcgcca

SEQ ID NO: 3601 - DNA, 19 bp, Artificial Sequence
  Description of Artificial Sequence: Synthetic oligonucleotide
agtcccatctgggtcgcca

SEQ ID NO: 3602 - DNA, 19 bp, Artificial Sequence
  Description of Artificial Sequence: Synthetic oligonucleotide
agtcccatctgggtcgcca

SEQ ID NO: 3603 - DNA, 19 bp, Artificial Sequence
  Description of Artificial Sequence: Synthetic oligonucleotide
agtcccatctgggtcgcca

SEQ ID NO: 3604 - DNA, 19 bp, Artificial Sequence
  Description of Artificial Sequence: Synthetic oligonucleotide
agtcccatctgggtcgcca

SEQ ID NO: 3605 - DNA, 19 bp, Artificial Sequence
  Description of Artificial Sequence: Synthetic oligonucleotide
agtcccatctgggtcgcca

SEQ ID NO: 3606 - DNA, 19 bp, Artificial Sequence
  Description of Artificial Sequence: Synthetic oligonucleotide
agtcccatctgggtcgcca

SEQ ID NO: 3607 - DNA, 19 bp, Artificial Sequence
  Description of Artificial Sequence: Synthetic oligonucleotide
agtcccatctgggtcgcca

SEQ ID NO: 3608 - DNA, 19 bp, Artificial Sequence
  Description of Artificial Sequence: Synthetic oligonucleotide
agtcccatctgggtcgcca

SEQ ID NO: 3609 - DNA, 19 bp, Artificial Sequence
  Description of Artificial Sequence: Synthetic oligonucleotide
agtcccatctgggtcgcca

SEQ ID NO: 3610 - DNA, 18 bp, Artificial Sequence
  Description of Artificial Sequence: Synthetic oligonucleotide
tccccgtacgggccacca

SEQ ID NO: 3611 - DNA, 18 bp, Artificial Sequence
  Description of Artificial Sequence: Synthetic oligonucleotide
tccccgtacgggccacca

SEQ ID NO: 3612 - DNA, 18 bp, Artificial Sequence
  Description of Artificial Sequence: Synthetic oligonucleotide
gtcccttcgtggtcgcca

SEQ ID NO: 3613 - DNA, 18 bp, Artificial Sequence
  Description of Artificial Sequence: Synthetic oligonucleotide
gtcccttcgtggtcgcca

SEQ ID NO: 3614 - DNA, 18 bp, Artificial Sequence
  Description of Artificial Sequence: Synthetic oligonucleotide
gtcccttcgtggtcgcca

SEQ ID NO: 3615 - DNA, 18 bp, Artificial Sequence
  Description of Artificial Sequence: Synthetic oligonucleotide
gtcccttcgtggtcgcca

SEQ ID NO: 3616 - DNA, 18 bp, Artificial Sequence
  Description of Artificial Sequence: Synthetic oligonucleotide
gtcccttcgtggtcgcca

SEQ ID NO: 3617 - DNA, 18 bp, Artificial Sequence
  Description of Artificial Sequence: Synthetic oligonucleotide
gtcccttcgtggtcgcca

SEQ ID NO: 3618 - DNA, 18 bp, Artificial Sequence
  Description of Artificial Sequence: Synthetic oligonucleotide
gtcccttcgtggtcgcca

SEQ ID NO: 3619 - DNA, 18 bp, Artificial Sequence
  Description of Artificial Sequence: Synthetic oligonucleotide
gtcccttcgtggtcgcca

SEQ ID NO: 3620 - DNA, 18 bp, Artificial Sequence
  Description of Artificial Sequence: Synthetic oligonucleotide
gtcccttcgtggtcgcca

SEQ ID NO: 3621 - DNA, 21 bp, Artificial Sequence
  Description of Artificial Sequence: Synthetic oligonucleotide
gtcaggatggccgagcggtct

SEQ ID NO: 3622 - DNA, 21 bp, Artificial Sequence
  Description of Artificial Sequence: Synthetic oligonucleotide
gtcaggatggccgagcggtct

SEQ ID NO: 3623 - DNA, 21 bp, Artificial Sequence
  Description of Artificial Sequence: Synthetic oligonucleotide
gtcaggatggccgagcggtct

SEQ ID NO: 3624 - DNA, 21 bp, Artificial Sequence
  Description of Artificial Sequence: Synthetic oligonucleotide
gtcaggatggccgagcggtct

SEQ ID NO: 3625 - DNA, 21 bp, Artificial Sequence
  Description of Artificial Sequence: Synthetic oligonucleotide
gtcaggatggccgagcggtct

SEQ ID NO: 3626 - DNA, 21 bp, Artificial Sequence
  Description of Artificial Sequence: Synthetic oligonucleotide
gtcaggatggccgagcggtct

SEQ ID NO: 3627 - DNA, 21 bp, Artificial Sequence
  Description of Artificial Sequence: Synthetic oligonucleotide
gtcaggatggccgagcggtct

SEQ ID NO: 3628 - DNA, 21 bp, Artificial Sequence
  Description of Artificial Sequence: Synthetic oligonucleotide
gtcaggatggccgagcggtct

SEQ ID NO: 3629 - DNA, 17 bp, Artificial Sequence
  Description of Artificial Sequence: Synthetic oligonucleotide
aggggggtaaaaaaaaa

SEQ ID NO: 3630 - DNA, 17 bp, Artificial Sequence
  Description of Artificial Sequence: Synthetic oligonucleotide
aggggggtaaaaaaaaa

SEQ ID NO: 3631 - DNA, 17 bp, Artificial Sequence
  Description of Artificial Sequence: Synthetic oligonucleotide
cccacccagggacgcca

SEQ ID NO: 3632 - DNA, 17 bp, Artificial Sequence
  Description of Artificial Sequence: Synthetic oligonucleotide
cccacccagggacgcca

SEQ ID NO: 3633 - DNA, 17 bp, Artificial Sequence
  Description of Artificial Sequence: Synthetic oligonucleotide
cccacccagggacgcca

SEQ ID NO: 3634 - DNA, 17 bp, Artificial Sequence
  Description of Artificial Sequence: Synthetic oligonucleotide
cccacccagggacgcca

SEQ ID NO: 3635 - DNA, 17 bp, Artificial Sequence
  Description of Artificial Sequence: Synthetic oligonucleotide
cccacccagggacgcca

SEQ ID NO: 3636 - DNA, 18 bp, Artificial Sequence
  Description of Artificial Sequence: Synthetic oligonucleotide
tccccggcacctccacca

SEQ ID NO: 3637 - DNA, 18 bp, Artificial Sequence
  Description of Artificial Sequence: Synthetic oligonucleotide
gagggggaccaaaaaaaa

SEQ ID NO: 3638 - DNA, 19 bp, Artificial Sequence
  Description of Artificial Sequence: Synthetic oligonucleotide
taccgagcctggtgatagc

SEQ ID NO: 3639 - DNA, 19 bp, Artificial Sequence
  Description of Artificial Sequence: Synthetic oligonucleotide
taccgagcctggtgatagc

SEQ ID NO: 3640 - DNA, 22 bp, Artificial Sequence
  Description of Artificial Sequence: Synthetic oligonucleotide
tcgattcccggccaatgcacca

SEQ ID NO: 3641 - DNA, 22 bp, Artificial Sequence
  Description of Artificial Sequence: Synthetic oligonucleotide
tcgattcccggccaatgcacca

SEQ ID NO: 3642 - DNA, 23 bp, Artificial Sequence
  Description of Artificial Sequence: Synthetic oligonucleotide
gagccatgatgataccactgagc

SEQ ID NO: 3643 - DNA, 17 bp, Artificial Sequence
  Description of Artificial Sequence: Synthetic oligonucleotide
taacggccgcggtaccc

SEQ ID NO: 3644 - DNA, 17 bp, Artificial Sequence
  Description of Artificial Sequence: Synthetic oligonucleotide
taacggccgcggtaccc

SEQ ID NO: 3645 - DNA, 23 bp, Artificial Sequence
  Description of Artificial Sequence: Synthetic oligonucleotide
gcagcgccagcctcccgccctac

SEQ ID NO: 3646 - DNA, 19 bp, Artificial Sequence
  Description of Artificial Sequence: Synthetic oligonucleotide
cgtccatgatgttccgcaa

SEQ ID NO: 3647 - DNA, 27 bp, Artificial Sequence
  Description of Artificial Sequence: Synthetic oligonucleotide
agcagtgatgtcctgaaaattctgaag

SEQ ID NO: 3648 - DNA, 20 bp, Artificial Sequence
  Description of Artificial Sequence: Synthetic oligonucleotide
aaaggacctggcggtgcttc

SEQ ID NO: 3649 - DNA, 20 bp, Artificial Sequence
  Description of Artificial Sequence: Synthetic oligonucleotide
aaaggacctggcggtgcttc

SEQ ID NO: 3650 - DNA, 20 bp, Artificial Sequence
  Description of Artificial Sequence: Synthetic oligonucleotide
aaaggacctggcggtgcttc

SEQ ID NO: 3651 - DNA, 18 bp, Artificial Sequence
  Description of Artificial Sequence: Synthetic oligonucleotide
atcccggacgagccccca

SEQ ID NO: 3652 - DNA, 18 bp, Artificial Sequence
  Description of Artificial Sequence: Synthetic oligonucleotide
atcccggacgagccccca

SEQ ID NO: 3653 - DNA, 18 bp, Artificial Sequence
  Description of Artificial Sequence: Synthetic oligonucleotide
atcccggacgagccccca

SEQ ID NO: 3654 - DNA, 18 bp, Artificial Sequence
  Description of Artificial Sequence: Synthetic oligonucleotide
atcccggacgagccccca

SEQ ID NO: 3655 - DNA, 18 bp, Artificial Sequence
  Description of Artificial Sequence: Synthetic oligonucleotide
atcccggacgagccccca

SEQ ID NO: 3656 - DNA, 18 bp, Artificial Sequence
  Description of Artificial Sequence: Synthetic oligonucleotide
tcctcacacggggcacca

SEQ ID NO: 3657 - DNA, 18 bp, Artificial Sequence
  Description of Artificial Sequence: Synthetic oligonucleotide
tcctcacacggggcacca

SEQ ID NO: 3658 - DNA, 18 bp, Artificial Sequence
  Description of Artificial Sequence: Synthetic oligonucleotide
atcccacttctgacacca

SEQ ID NO: 3659 - DNA, 18 bp, Artificial Sequence
  Description of Artificial Sequence: Synthetic oligonucleotide
atcccacttctgacacca

SEQ ID NO: 3660 - DNA, 18 bp, Artificial Sequence
  Description of Artificial Sequence: Synthetic oligonucleotide
atcccacttctgacacca

SEQ ID NO: 3661 - DNA, 18 bp, Artificial Sequence
  Description of Artificial Sequence: Synthetic oligonucleotide
atcccacttctgacacca

SEQ ID NO: 3662 - DNA, 18 bp, Artificial Sequence
  Description of Artificial Sequence: Synthetic oligonucleotide
atcccacttctgacacca

SEQ ID NO: 3663 - DNA, 18 bp, Artificial Sequence
  Description of Artificial Sequence: Synthetic oligonucleotide
atcccacttctgacacca

SEQ ID NO: 3664 - DNA, 18 bp, Artificial Sequence
  Description of Artificial Sequence: Synthetic oligonucleotide
atcccacttctgacacca

SEQ ID NO: 3665 - DNA, 18 bp, Artificial Sequence
  Description of Artificial Sequence: Synthetic oligonucleotide
atcccacttctgacacca

SEQ ID NO: 3666 - DNA, 18 bp, Artificial Sequence
  Description of Artificial Sequence: Synthetic oligonucleotide
atcccacttctgacacca

SEQ ID NO: 3667 - DNA, 20 bp, Artificial Sequence
  Description of Artificial Sequence: Synthetic oligonucleotide
accccactatgcttagccct

SEQ ID NO: 3668 - DNA, 17 bp, Artificial Sequence
  Description of Artificial Sequence: Synthetic oligonucleotide
tgtattgtgagacattc

SEQ ID NO: 3669 - DNA, 17 bp, Artificial Sequence
  Description of Artificial Sequence: Synthetic oligonucleotide
tctcggtggaacctcca

SEQ ID NO: 3670 - DNA, 17 bp, Artificial Sequence
  Description of Artificial Sequence: Synthetic oligonucleotide
tctcggtggaacctcca

SEQ ID NO: 3671 - DNA, 19 bp, Artificial Sequence
  Description of Artificial Sequence: Synthetic oligonucleotide
atccccagcacctccacca

SEQ ID NO: 3672 - DNA, 18 bp, Artificial Sequence
  Description of Artificial Sequence: Synthetic oligonucleotide
agaacactacgagccaca

SEQ ID NO: 3673 - DNA, 18 bp, Artificial Sequence
  Description of Artificial Sequence: Synthetic oligonucleotide
agaacactacgagccaca

SEQ ID NO: 3674 - DNA, 18 bp, Artificial Sequence
  Description of Artificial Sequence: Synthetic oligonucleotide
agaacactacgagccaca

SEQ ID NO: 3675 - DNA, 18 bp, Artificial Sequence
  Description of Artificial Sequence: Synthetic oligonucleotide
accccacttctggtacca

SEQ ID NO: 3676 - DNA, 18 bp, Artificial Sequence
  Description of Artificial Sequence: Synthetic oligonucleotide
accccacttctggtacca

SEQ ID NO: 3677 - DNA, 18 bp, Artificial Sequence
  Description of Artificial Sequence: Synthetic oligonucleotide
accccacttctggtacca

SEQ ID NO: 3678 - DNA, 18 bp, Artificial Sequence
  Description of Artificial Sequence: Synthetic oligonucleotide
accccacttctggtacca

SEQ ID NO: 3679 - DNA, 18 bp, Artificial Sequence
  Description of Artificial Sequence: Synthetic oligonucleotide
accccacttctggtacca

SEQ ID NO: 3680 - DNA, 18 bp, Artificial Sequence
  Description of Artificial Sequence: Synthetic oligonucleotide
accccacttctggtacca

SEQ ID NO: 3681 - DNA, 18 bp, Artificial Sequence
  Description of Artificial Sequence: Synthetic oligonucleotide
accccacttctggtacca

SEQ ID NO: 3682 - DNA, 18 bp, Artificial Sequence
  Description of Artificial Sequence: Synthetic oligonucleotide
accccacttctggtacca

SEQ ID NO: 3683 - DNA, 18 bp, Artificial Sequence
  Description of Artificial Sequence: Synthetic oligonucleotide
accccacttctggtacca

SEQ ID NO: 3684 - DNA, 18 bp, Artificial Sequence
  Description of Artificial Sequence: Synthetic oligonucleotide
accccacttctggtacca

SEQ ID NO: 3685 - DNA, 18 bp, Artificial Sequence
  Description of Artificial Sequence: Synthetic oligonucleotide
accccacttctggtacca

SEQ ID NO: 3686 - DNA, 18 bp, Artificial Sequence
  Description of Artificial Sequence: Synthetic oligonucleotide
accccacttctggtacca

SEQ ID NO: 3687 - DNA, 18 bp, Artificial Sequence
  Description of Artificial Sequence: Synthetic oligonucleotide
accccacttctggtacca

SEQ ID NO: 3688 - DNA, 18 bp, Artificial Sequence
  Description of Artificial Sequence: Synthetic oligonucleotide
accccacttctggtacca

SEQ ID NO: 3689 - DNA, 18 bp, Artificial Sequence
  Description of Artificial Sequence: Synthetic oligonucleotide
accccacttctggtacca

SEQ ID NO: 3690 - DNA, 18 bp, Artificial Sequence
  Description of Artificial Sequence: Synthetic oligonucleotide
accccacttctggtacca

SEQ ID NO: 3691 - DNA, 18 bp, Artificial Sequence
  Description of Artificial Sequence: Synthetic oligonucleotide
accccacttctggtacca

SEQ ID NO: 3692 - DNA, 18 bp, Artificial Sequence
  Description of Artificial Sequence: Synthetic oligonucleotide
accccacttctggtacca

SEQ ID NO: 3693 - DNA, 18 bp, Artificial Sequence
  Description of Artificial Sequence: Synthetic oligonucleotide
accccacttctggtacca

SEQ ID NO: 3694 - DNA, 18 bp, Artificial Sequence
  Description of Artificial Sequence: Synthetic oligonucleotide
accccacttctggtacca

SEQ ID NO: 3695 - DNA, 18 bp, Artificial Sequence
  Description of Artificial Sequence: Synthetic oligonucleotide
accccacttctggtacca

SEQ ID NO: 3696 - DNA, 18 bp, Artificial Sequence
  Description of Artificial Sequence: Synthetic oligonucleotide
accccacttctggtacca

SEQ ID NO: 3697 - DNA, 18 bp, Artificial Sequence
  Description of Artificial Sequence: Synthetic oligonucleotide
accccacttctggtacca

SEQ ID NO: 3698 - DNA, 18 bp, Artificial Sequence
  Description of Artificial Sequence: Synthetic oligonucleotide
accccacttctggtacca

SEQ ID NO: 3699 - DNA, 18 bp, Artificial Sequence
  Description of Artificial Sequence: Synthetic oligonucleotide
accccacttctggtacca

SEQ ID NO: 3700 - DNA, 18 bp, Artificial Sequence
  Description of Artificial Sequence: Synthetic oligonucleotide
accccacttctggtacca

SEQ ID NO: 3701 - DNA, 18 bp, Artificial Sequence
  Description of Artificial Sequence: Synthetic oligonucleotide
accccacttctggtacca

SEQ ID NO: 3702 - DNA, 18 bp, Artificial Sequence
  Description of Artificial Sequence: Synthetic oligonucleotide
accccacttctggtacca

SEQ ID NO: 3703 - DNA, 18 bp, Artificial Sequence
  Description of Artificial Sequence: Synthetic oligonucleotide
accccacttctggtacca

SEQ ID NO: 3704 - DNA, 18 bp, Artificial Sequence
  Description of Artificial Sequence: Synthetic oligonucleotide
accccacttctggtacca

SEQ ID NO: 3705 - DNA, 18 bp, Artificial Sequence
  Description of Artificial Sequence: Synthetic oligonucleotide
accccacttctggtacca

SEQ ID NO: 3706 - DNA, 18 bp, Artificial Sequence
  Description of Artificial Sequence: Synthetic oligonucleotide
accccacttctggtacca

SEQ ID NO: 3707 - DNA, 18 bp, Artificial Sequence
  Description of Artificial Sequence: Synthetic oligonucleotide
accccacttctggtacca

SEQ ID NO: 3708 - DNA, 18 bp, Artificial Sequence
  Description of Artificial Sequence: Synthetic oligonucleotide
cgttcgcgctttcccctg

SEQ ID NO: 3709 - DNA, 18 bp, Artificial Sequence
  Description of Artificial Sequence: Synthetic oligonucleotide
cgttcgcgctttcccctg

SEQ ID NO: 3710 - DNA, 18 bp, Artificial Sequence
  Description of Artificial Sequence: Synthetic oligonucleotide
cgttcgcgctttcccctg

SEQ ID NO: 3711 - DNA, 18 bp, Artificial Sequence
  Description of Artificial Sequence: Synthetic oligonucleotide
cgttcgcgctttcccctg

SEQ ID NO: 3712 - DNA, 18 bp, Artificial Sequence
  Description of Artificial Sequence: Synthetic oligonucleotide
gacgaggtggccgagtgg

SEQ ID NO: 3713 - DNA, 18 bp, Artificial Sequence
  Description of Artificial Sequence: Synthetic oligonucleotide
gacgaggtggccgagtgg

SEQ ID NO: 3714 - DNA, 18 bp, Artificial Sequence
  Description of Artificial Sequence: Synthetic oligonucleotide
gacgaggtggccgagtgg

SEQ ID NO: 3715 - DNA, 18 bp, Artificial Sequence
  Description of Artificial Sequence: Synthetic oligonucleotide
gacgaggtggccgagtgg

SEQ ID NO: 3716 - DNA, 18 bp, Artificial Sequence
  Description of Artificial Sequence: Synthetic oligonucleotide
gacgaggtggccgagtgg

SEQ ID NO: 3717 - DNA, 18 bp, Artificial Sequence
  Description of Artificial Sequence: Synthetic oligonucleotide
gacgaggtggccgagtgg

SEQ ID NO: 3718 - DNA, 18 bp, Artificial Sequence
  Description of Artificial Sequence: Synthetic oligonucleotide
gacgaggtggccgagtgg

SEQ ID NO: 3719 - DNA, 18 bp, Artificial Sequence
  Description of Artificial Sequence: Synthetic oligonucleotide
gacgaggtggccgagtgg

SEQ ID NO: 3720 - DNA, 18 bp, Artificial Sequence
  Description of Artificial Sequence: Synthetic oligonucleotide
tccccggcatctccacca

SEQ ID NO: 3721 - DNA, 20 bp, Artificial Sequence
  Description of Artificial Sequence: Synthetic oligonucleotide
ctgattgctcctgtctgatt

SEQ ID NO: 3722 - DNA, 21 bp, Artificial Sequence
  Description of Artificial Sequence: Synthetic oligonucleotide
tctagaggagcctgttctgta

SEQ ID NO: 3723 - DNA, 22 bp, Artificial Sequence
  Description of Artificial Sequence: Synthetic oligonucleotide
tcgggtgcgagaggtcccgggt

SEQ ID NO: 3724 - DNA, 23 bp, Artificial Sequence
  Description of Artificial Sequence: Synthetic oligonucleotide
ataggtttggtcctagcctttct

SEQ ID NO: 3725 - DNA, 22 bp, Artificial Sequence
  Description of Artificial Sequence: Synthetic oligonucleotide
tcgattcccggtcagggaacca

SEQ ID NO: 3726 - DNA, 28 bp, Artificial Sequence
  Description of Artificial Sequence: Synthetic oligonucleotide
tcctcgttagtatagtggtgagtatccc

SEQ ID NO: 3727 - DNA, 28 bp, Artificial Sequence
  Description of Artificial Sequence: Synthetic oligonucleotide
tcctcgttagtatagtggtgagtatccc

SEQ ID NO: 3728 - DNA, 28 bp, Artificial Sequence
  Description of Artificial Sequence: Synthetic oligonucleotide
tcctcgttagtatagtggtgagtatccc

SEQ ID NO: 3729 - DNA, 28 bp, Artificial Sequence
  Description of Artificial Sequence: Synthetic oligonucleotide
tcctcgttagtatagtggtgagtatccc

SEQ ID NO: 3730 - DNA, 28 bp, Artificial Sequence
  Description of Artificial Sequence: Synthetic oligonucleotide
tcctcgttagtatagtggtgagtatccc

SEQ ID NO: 3731 - DNA, 28 bp, Artificial Sequence
  Description of Artificial Sequence: Synthetic oligonucleotide
tcctcgttagtatagtggtgagtatccc

SEQ ID NO: 3732 - DNA, 28 bp, Artificial Sequence
  Description of Artificial Sequence: Synthetic oligonucleotide
tcctcgttagtatagtggtgagtatccc

SEQ ID NO: 3733 - DNA, 28 bp, Artificial Sequence
  Description of Artificial Sequence: Synthetic oligonucleotide
tcctcgttagtatagtggtgagtatccc

SEQ ID NO: 3734 - DNA, 28 bp, Artificial Sequence
  Description of Artificial Sequence: Synthetic oligonucleotide
tcctcgttagtatagtggtgagtatccc

SEQ ID NO: 3735 - DNA, 28 bp, Artificial Sequence
  Description of Artificial Sequence: Synthetic oligonucleotide
tcctcgttagtatagtggtgagtatccc

SEQ ID NO: 3736 - DNA, 28 bp, Artificial Sequence
  Description of Artificial Sequence: Synthetic oligonucleotide
tcctcgttagtatagtggtgagtatccc

SEQ ID NO: 3737 - DNA, 28 bp, Artificial Sequence
  Description of Artificial Sequence: Synthetic oligonucleotide
tccctggtggtctagtggttaggattcg

SEQ ID NO: 3738 - DNA, 28 bp, Artificial Sequence
  Description of Artificial Sequence: Synthetic oligonucleotide
tccctggtggtctagtggttaggattcg

SEQ ID NO: 3739 - DNA, 28 bp, Artificial Sequence
  Description of Artificial Sequence: Synthetic oligonucleotide
tccctggtggtctagtggttaggattcg

SEQ ID NO: 3740 - DNA, 28 bp, Artificial Sequence
  Description of Artificial Sequence: Synthetic oligonucleotide
tccctggtggtctagtggttaggattcg

SEQ ID NO: 3741 - DNA, 28 bp, Artificial Sequence
  Description of Artificial Sequence: Synthetic oligonucleotide
tccctggtggtctagtggttaggattcg

SEQ ID NO: 3742 - DNA, 28 bp, Artificial Sequence
  Description of Artificial Sequence: Synthetic oligonucleotide
tccctggtggtctagtggttaggattcg

SEQ ID NO: 3743 - DNA, 28 bp, Artificial Sequence
  Description of Artificial Sequence: Synthetic oligonucleotide
tccctggtggtctagtggttaggattcg

SEQ ID NO: 3744 - DNA, 17 bp, Artificial Sequence
  Description of Artificial Sequence: Synthetic oligonucleotide
taagtgtttgtgggtta

SEQ ID NO: 3745 - DNA, 22 bp, Artificial Sequence
  Description of Artificial Sequence: Synthetic oligonucleotide
gcattggtggttcagtggtaga

SEQ ID NO: 3746 - DNA, 22 bp, Artificial Sequence
  Description of Artificial Sequence: Synthetic oligonucleotide
gcattggtggttcagtggtaga

SEQ ID NO: 3747 - DNA, 22 bp, Artificial Sequence
  Description of Artificial Sequence: Synthetic oligonucleotide
gcattggtggttcagtggtaga

SEQ ID NO: 3748 - DNA, 22 bp, Artificial Sequence
  Description of Artificial Sequence: Synthetic oligonucleotide
gcattggtggttcagtggtaga

SEQ ID NO: 3749 - DNA, 22 bp, Artificial Sequence
  Description of Artificial Sequence: Synthetic oligonucleotide
gcattggtggttcagtggtaga

SEQ ID NO: 3750 - DNA, 22 bp, Artificial Sequence
  Description of Artificial Sequence: Synthetic oligonucleotide
gcattggtggttcagtggtaga

SEQ ID NO: 3751 - DNA, 22 bp, Artificial Sequence
  Description of Artificial Sequence: Synthetic oligonucleotide
gcattggtggttcagtggtaga

SEQ ID NO: 3752 - DNA, 22 bp, Artificial Sequence
  Description of Artificial Sequence: Synthetic oligonucleotide
gcattggtggttcagtggtaga

SEQ ID NO: 3753 - DNA, 22 bp, Artificial Sequence
  Description of Artificial Sequence: Synthetic oligonucleotide
gcattggtggttcagtggtaga

SEQ ID NO: 3754 - DNA, 22 bp, Artificial Sequence
  Description of Artificial Sequence: Synthetic oligonucleotide
gcattggtggttcagtggtaga

SEQ ID NO: 3755 - DNA, 22 bp, Artificial Sequence
  Description of Artificial Sequence: Synthetic oligonucleotide
gcattggtggttcagtggtaga

SEQ ID NO: 3756 - DNA, 17 bp, Artificial Sequence
  Description of Artificial Sequence: Synthetic oligonucleotide
tggttatcacgttcgcc

SEQ ID NO: 3757 - DNA, 17 bp, Artificial Sequence
  Description of Artificial Sequence: Synthetic oligonucleotide
tggttatcacgttcgcc

SEQ ID NO: 3758 - DNA, 17 bp, Artificial Sequence
  Description of Artificial Sequence: Synthetic oligonucleotide
tggttatcacgttcgcc

SEQ ID NO: 3759 - DNA, 17 bp, Artificial Sequence
  Description of Artificial Sequence: Synthetic oligonucleotide
tggttatcacgttcgcc

SEQ ID NO: 3760 - DNA, 17 bp, Artificial Sequence
  Description of Artificial Sequence: Synthetic oligonucleotide
tggttatcacgttcgcc

SEQ ID NO: 3761 - DNA, 17 bp, Artificial Sequence
  Description of Artificial Sequence: Synthetic oligonucleotide
ccctgctcgctgcgcca

SEQ ID NO: 3762 - DNA, 22 bp, Artificial Sequence
  Description of Artificial Sequence: Synthetic oligonucleotide
ttctcactactgcacttgacta

SEQ ID NO: 3763 - DNA, 22 bp, Artificial Sequence
  Description of Artificial Sequence: Synthetic oligonucleotide
ttctcactactgcacttgacta

SEQ ID NO: 3764 - DNA, 22 bp, Artificial Sequence
  Description of Artificial Sequence: Synthetic oligonucleotide
ttctcactactgcacttgacta

SEQ ID NO: 3765 - DNA, 22 bp, Artificial Sequence
  Description of Artificial Sequence: Synthetic oligonucleotide
ttctcactactgcacttgacta

SEQ ID NO: 3766 - DNA, 18 bp, Artificial Sequence
  Description of Artificial Sequence: Synthetic oligonucleotide
ctcctggctggctcgcca

SEQ ID NO: 3767 - DNA, 18 bp, Artificial Sequence
  Description of Artificial Sequence: Synthetic oligonucleotide
ctcctggctggctcgcca

SEQ ID NO: 3768 - DNA, 24 bp, Artificial Sequence
  Description of Artificial Sequence: Synthetic oligonucleotide
ctcccactgcttcacttgactagc

SEQ ID NO: 3769 - DNA, 24 bp, Artificial Sequence
  Description of Artificial Sequence: Synthetic oligonucleotide
ctcccactgcttcacttgactagc

SEQ ID NO: 3770 - DNA, 24 bp, Artificial Sequence
  Description of Artificial Sequence: Synthetic oligonucleotide
ctcccactgcttcacttgactagc

SEQ ID NO: 3771 - DNA, 24 bp, Artificial Sequence
  Description of Artificial Sequence: Synthetic oligonucleotide
ctcccactgcttcacttgactagc

SEQ ID NO: 3772 - DNA, 24 bp, Artificial Sequence
  Description of Artificial Sequence: Synthetic oligonucleotide
ctcccactgcttcacttgactagc

SEQ ID NO: 3773 - DNA, 24 bp, Artificial Sequence
  Description of Artificial Sequence: Synthetic oligonucleotide
ctcccactgcttcacttgactagc

SEQ ID NO: 3774 - DNA, 17 bp, Artificial Sequence
  Description of Artificial Sequence: Synthetic oligonucleotide
ctgctgtgatgacattc

SEQ ID NO: 3775 - DNA, 17 bp, Artificial Sequence
  Description of Artificial Sequence: Synthetic oligonucleotide
tcctgccgcggtcgcca

SEQ ID NO: 3776 - DNA, 27 bp, Artificial Sequence
  Description of Artificial Sequence: Synthetic oligonucleotide
gcgggtgatgcgaactggagtctgagc

SEQ ID NO: 3777 - DNA, 24 bp, Artificial Sequence
  Description of Artificial Sequence: Synthetic oligonucleotide
cccccacaaccgcgcttgactagc

SEQ ID NO: 3778 - DNA, 19 bp, Artificial Sequence
  Description of Artificial Sequence: Synthetic oligonucleotide
taggggtatgattctcgct

SEQ ID NO: 3779 - DNA, 19 bp, Artificial Sequence
  Description of Artificial Sequence: Synthetic oligonucleotide
taggggtatgattctcgct

SEQ ID NO: 3780 - DNA, 19 bp, Artificial Sequence
  Description of Artificial Sequence: Synthetic oligonucleotide
taggggtatgattctcgct

SEQ ID NO: 3781 - DNA, 19 bp, Artificial Sequence
  Description of Artificial Sequence: Synthetic oligonucleotide
taggggtatgattctcgct

SEQ ID NO: 3782 - DNA, 19 bp, Artificial Sequence
  Description of Artificial Sequence: Synthetic oligonucleotide
taggggtatgattctcgct

SEQ ID NO: 3783 - DNA, 19 bp, Artificial Sequence
  Description of Artificial Sequence: Synthetic oligonucleotide
taggggtatgattctcgct

SEQ ID NO: 3784 - DNA, 19 bp, Artificial Sequence
  Description of Artificial Sequence: Synthetic oligonucleotide
taggggtatgattctcgct

SEQ ID NO: 3785 - DNA, 19 bp, Artificial Sequence
  Description of Artificial Sequence: Synthetic oligonucleotide
taggggtatgattctcgct

SEQ ID NO: 3786 - DNA, 19 bp, Artificial Sequence
  Description of Artificial Sequence: Synthetic oligonucleotide
taggggtatgattctcgct

SEQ ID NO: 3787 - DNA, 19 bp, Artificial Sequence
  Description of Artificial Sequence: Synthetic oligonucleotide
taggggtatgattctcgct

SEQ ID NO: 3788 - DNA, 19 bp, Artificial Sequence
  Description of Artificial Sequence: Synthetic oligonucleotide
taggggtatgattctcgct

SEQ ID NO: 3789 - DNA, 19 bp, Artificial Sequence
  Description of Artificial Sequence: Synthetic oligonucleotide
taggggtatgattctcgct

SEQ ID NO: 3790 - DNA, 19 bp, Artificial Sequence
  Description of Artificial Sequence: Synthetic oligonucleotide
taggggtatgattctcgct

SEQ ID NO: 3791 - DNA, 19 bp, Artificial Sequence
  Description of Artificial Sequence: Synthetic oligonucleotide
taggggtatgattctcgct

SEQ ID NO: 3792 - DNA, 19 bp, Artificial Sequence
  Description of Artificial Sequence: Synthetic oligonucleotide
taggggtatgattctcgct

SEQ ID NO: 3793 - DNA, 19 bp, Artificial Sequence
  Description of Artificial Sequence: Synthetic oligonucleotide
taggggtatgattctcgct

SEQ ID NO: 3794 - DNA, 26 bp, Artificial Sequence
  Description of Artificial Sequence: Synthetic oligonucleotide
ggctggtccgagtgcagtggtgttta

SEQ ID NO: 3795 - DNA, 26 bp, Artificial Sequence
  Description of Artificial Sequence: Synthetic oligonucleotide
ggctggtccgagtgcagtggtgttta

SEQ ID NO: 3796 - DNA, 26 bp, Artificial Sequence
  Description of Artificial Sequence: Synthetic oligonucleotide
ggctggtccgagtgcagtggtgttta

SEQ ID NO: 3797 - DNA, 26 bp, Artificial Sequence
  Description of Artificial Sequence: Synthetic oligonucleotide
ggctggtccgagtgcagtggtgttta

SEQ ID NO: 3798 - DNA, 26 bp, Artificial Sequence
  Description of Artificial Sequence: Synthetic oligonucleotide
ggctggtccgagtgcagtggtgttta

SEQ ID NO: 3799 - DNA, 26 bp, Artificial Sequence
  Description of Artificial Sequence: Synthetic oligonucleotide
ggctggtccgagtgcagtggtgttta

SEQ ID NO: 3800 - DNA, 26 bp, Artificial Sequence
  Description of Artificial Sequence: Synthetic oligonucleotide
ggctggtccgagtgcagtggtgttta

SEQ ID NO: 3801 - DNA, 23 bp, Artificial Sequence
  Description of Artificial Sequence: Synthetic oligonucleotide
ggctggtccgatggtagtgggtt

SEQ ID NO: 3802 - DNA, 23 bp, Artificial Sequence
  Description of Artificial Sequence: Synthetic oligonucleotide
ggctggtccgatggtagtgggtt

SEQ ID NO: 3803 - DNA, 20 bp, Artificial Sequence
  Description of Artificial Sequence: Synthetic oligonucleotide
ccacgaggaagagaggtagc

SEQ ID NO: 3804 - DNA, 18 bp, Artificial Sequence
  Description of Artificial Sequence: Synthetic oligonucleotide
cggaagcgtgctgggccc

SEQ ID NO: 3805 - DNA, 18 bp, Artificial Sequence
  Description of Artificial Sequence: Synthetic oligonucleotide
cggaagcgtgctgggccc

SEQ ID NO: 3806 - DNA, 18 bp, Artificial Sequence
  Description of Artificial Sequence: Synthetic oligonucleotide
cggaagcgtgctgggccc

SEQ ID NO: 3807 - DNA, 18 bp, Artificial Sequence
  Description of Artificial Sequence: Synthetic oligonucleotide
cggaagcgtgctgggccc

SEQ ID NO: 3808 - DNA, 18 bp, Artificial Sequence
  Description of Artificial Sequence: Synthetic oligonucleotide
cggaagcgtgctgggccc

SEQ ID NO: 3809 - DNA, 23 bp, Artificial Sequence
  Description of Artificial Sequence: Synthetic oligonucleotide
ggagagaacgcggtctgagtggt

SEQ ID NO: 3810 - DNA, 23 bp, Artificial Sequence
  Description of Artificial Sequence: Synthetic oligonucleotide
ggagagaacgcggtctgagtggt

SEQ ID NO: 3811 - DNA, 23 bp, Artificial Sequence
  Description of Artificial Sequence: Synthetic oligonucleotide
ggagagaacgcggtctgagtggt

SEQ ID NO: 3812 - DNA, 23 bp, Artificial Sequence
  Description of Artificial Sequence: Synthetic oligonucleotide
ggagagaacgcggtctgagtggt

SEQ ID NO: 3813 - DNA, 23 bp, Artificial Sequence
  Description of Artificial Sequence: Synthetic oligonucleotide
ggagagaacgcggtctgagtggt

SEQ ID NO: 3814 - DNA, 19 bp, Artificial Sequence
  Description of Artificial Sequence: Synthetic oligonucleotide
atccccagcatctccacca

SEQ ID NO: 3815 - DNA, 25 bp, Artificial Sequence
  Description of Artificial Sequence: Synthetic oligonucleotide
ccccccactgctaaatttgactgga

SEQ ID NO: 3816 - DNA, 19 bp, Artificial Sequence
  Description of Artificial Sequence: Synthetic oligonucleotide
cagcatcagcagcatcatc

SEQ ID NO: 3817 - DNA, 22 bp, Artificial Sequence
  Description of Artificial Sequence: Synthetic oligonucleotide
tcaaaactgaggggcattttct

SEQ ID NO: 3818 - DNA, 18 bp, Artificial Sequence
  Description of Artificial Sequence: Synthetic oligonucleotide
cagggaggtgaatgtgat

SEQ ID NO: 3819 - DNA, 22 bp, Artificial Sequence
  Description of Artificial Sequence: Synthetic oligonucleotide
gaacaccaggagaaatcggtca

SEQ ID NO: 3820 - DNA, 24 bp, Artificial Sequence
  Description of Artificial Sequence: Synthetic oligonucleotide
ccagacagaattctatgcactttc

SEQ ID NO: 3821 - DNA, 23 bp, Artificial Sequence
  Description of Artificial Sequence: Synthetic oligonucleotide
cactgtgggccctctccgcacca

SEQ ID NO: 3822 - DNA, 22 bp, Artificial Sequence
  Description of Artificial Sequence: Synthetic oligonucleotide
ttatggcccttcggtaattcac

SEQ ID NO: 3823 - DNA, 22 bp, Artificial Sequence
  Description of Artificial Sequence: Synthetic oligonucleotide
tttttcattattgctcctgacc

SEQ ID NO: 3824 - DNA, 22 bp, Artificial Sequence
  Description of Artificial Sequence: Synthetic oligonucleotide
agttttgcatagttgcactaca

SEQ ID NO: 3825 - DNA, 22 bp, Artificial Sequence
  Description of Artificial Sequence: Synthetic oligonucleotide
agtaacaatcgaaagccacggt

SEQ ID NO: 3826 - DNA, 24 bp, Artificial Sequence
  Description of Artificial Sequence: Synthetic oligonucleotide
agtgtgagttctaccattgccaaa

SEQ ID NO: 3827 - DNA, 22 bp, Artificial Sequence
  Description of Artificial Sequence: Synthetic oligonucleotide
tggagtgtgacaatggtgtttg

SEQ ID NO: 3828 - DNA, 22 bp, Artificial Sequence
  Description of Artificial Sequence: Synthetic oligonucleotide
ccaatattactgtgctgcttta

SEQ ID NO: 3829 - DNA, 20 bp, Artificial Sequence
  Description of Artificial Sequence: Synthetic oligonucleotide
taaggcacgcggtgaatgcc

SEQ ID NO: 3830 - DNA, 20 bp, Artificial Sequence
  Description of Artificial Sequence: Synthetic oligonucleotide
ggcattcaccgcgtgcctta

SEQ ID NO: 3831 - DNA, 20 bp, Artificial Sequence
  Description of Artificial Sequence: Synthetic oligonucleotide
taaggcacgcggtgaatgcc

SEQ ID NO: 3832 - DNA, 22 bp, Artificial Sequence
  Description of Artificial Sequence: Synthetic oligonucleotide
tcgtaccgtgagtaataatgcg

SEQ ID NO: 3833 - DNA, 22 bp, Artificial Sequence
  Description of Artificial Sequence: Synthetic oligonucleotide
atggcaatatgttggcatagca

SEQ ID NO: 3834 - DNA, 21 bp, Artificial Sequence
  Description of Artificial Sequence: Synthetic oligonucleotide
tcacagtgaaccggtctcttt

SEQ ID NO: 3835 - DNA, 21 bp, Artificial Sequence
  Description of Artificial Sequence: Synthetic oligonucleotide
tcacagtgaaccggtctcttt

SEQ ID NO: 3836 - DNA, 23 bp, Artificial Sequence
  Description of Artificial Sequence: Synthetic oligonucleotide
tgtgcaaatctatgcaaaactga

SEQ ID NO: 3837 - DNA, 22 bp, Artificial Sequence
  Description of Artificial Sequence: Synthetic oligonucleotide
ctacaaagggaagcactttctc

SEQ ID NO: 3838 - DNA, 23 bp, Artificial Sequence
  Description of Artificial Sequence: Synthetic oligonucleotide
tcagttttgcatggatttgcaca

SEQ ID NO: 3839 - DNA, 23 bp, Artificial Sequence
  Description of Artificial Sequence: Synthetic oligonucleotide
tgtgcaaatccatgcaaaactga

SEQ ID NO: 3840 - DNA, 22 bp, Artificial Sequence
  Description of Artificial Sequence: Synthetic oligonucleotide
aagttctgttatacactcaggc

SEQ ID NO: 3841 - DNA, 21 bp, Artificial Sequence
  Description of Artificial Sequence: Synthetic oligonucleotide
ggtcagaacccatcattcact

SEQ ID NO: 3842 - DNA, 24 bp, Artificial Sequence
  Description of Artificial Sequence: Synthetic oligonucleotide
agcctggaagctggagcctgcagt

SEQ ID NO: 3843 - DNA, 21 bp, Artificial Sequence
  Description of Artificial Sequence: Synthetic oligonucleotide
gcagtccatgggcatatacac

SEQ ID NO: 3844 - DNA, 21 bp, Artificial Sequence
  Description of Artificial Sequence: Synthetic oligonucleotide
tgcaggctgatcttcttctct

SEQ ID NO: 3845 - DNA, 21 bp, Artificial Sequence
  Description of Artificial Sequence: Synthetic oligonucleotide
aaaggccacatccagcaccgt

SEQ ID NO: 3846 - DNA, 21 bp, Artificial Sequence
  Description of Artificial Sequence: Synthetic oligonucleotide
actctagctgccaaaggcgct

SEQ ID NO: 3847 - DNA, 21 bp, Artificial Sequence
  Description of Artificial Sequence: Synthetic oligonucleotide
agttaggattaggtcgtggaa

SEQ ID NO: 3848 - DNA, 21 bp, Artificial Sequence
  Description of Artificial Sequence: Synthetic oligonucleotide
ttccacgacctaatcctaact

SEQ ID NO: 3849 - DNA, 21 bp, Artificial Sequence
  Description of Artificial Sequence: Synthetic oligonucleotide
atatatgatgacttagctttt

SEQ ID NO: 3850 - DNA, 18 bp, Artificial Sequence
  Description of Artificial Sequence: Synthetic oligonucleotide
tcagctggccctcatttc

SEQ ID NO: 3851 - DNA, 22 bp, Artificial Sequence
  Description of Artificial Sequence: Synthetic oligonucleotide
aatcactaaccacacggccagg

SEQ ID NO: 3852 - DNA, 22 bp, Artificial Sequence
  Description of Artificial Sequence: Synthetic oligonucleotide
gctgccgtatatgtgatgtcac

SEQ ID NO: 3853 - DNA, 21 bp, Artificial Sequence
  Description of Artificial Sequence: Synthetic oligonucleotide
gaccaagaaatagcctttcaa

SEQ ID NO: 3854 - DNA, 22 bp, Artificial Sequence
  Description of Artificial Sequence: Synthetic oligonucleotide
gatgagctcattgtaatatgag

SEQ ID NO: 3855 - DNA, 22 bp, Artificial Sequence
  Description of Artificial Sequence: Synthetic oligonucleotide
tcaggctcagtcccctcccgat

SEQ ID NO: 3856 - DNA, 22 bp, Artificial Sequence
  Description of Artificial Sequence: Synthetic oligonucleotide
ctctagagggaagcgctttctg

SEQ ID NO: 3857 - DNA, 22 bp, Artificial Sequence
  Description of Artificial Sequence: Synthetic oligonucleotide
agctcccaagagcctaacccgt

SEQ ID NO: 3858 - DNA, 22 bp, Artificial Sequence
  Description of Artificial Sequence: Synthetic oligonucleotide
caacaaatcccagtctacctaa

SEQ ID NO: 3859 - DNA, 21 bp, Artificial Sequence
  Description of Artificial Sequence: Synthetic oligonucleotide
actttccaggattcattaact

SEQ ID NO: 3860 - DNA, 23 bp, Artificial Sequence
  Description of Artificial Sequence: Synthetic oligonucleotide
tgagtgtgtgtgtgtgagtgtgt

SEQ ID NO: 3861 - DNA, 21 bp, Artificial Sequence
  Description of Artificial Sequence: Synthetic oligonucleotide
aggggtgctatctgtgattga

SEQ ID NO: 3862 - DNA, 21 bp, Artificial Sequence
  Description of Artificial Sequence: Synthetic oligonucleotide
tggtagactatggaacgtagg

SEQ ID NO: 3863 - DNA, 21 bp, Artificial Sequence
  Description of Artificial Sequence: Synthetic oligonucleotide
aaagtgcttccttttagaggg

SEQ ID NO: 3864 - DNA, 21 bp, Artificial Sequence
  Description of Artificial Sequence: Synthetic oligonucleotide
aaagtgcttcctttttgaggg

SEQ ID NO: 3865 - DNA, 20 bp, Artificial Sequence
  Description of Artificial Sequence: Synthetic oligonucleotide
actcaaactgtgggggcact

SEQ ID NO: 3866 - DNA, 24 bp, Artificial Sequence
  Description of Artificial Sequence: Synthetic oligonucleotide
acaaagtgcttccctttagagtgt

SEQ ID NO: 3867 - DNA, 22 bp, Artificial Sequence
  Description of Artificial Sequence: Synthetic oligonucleotide
aagtgcttccttttagagggtt

SEQ ID NO: 3868 - DNA, 22 bp, Artificial Sequence
  Description of Artificial Sequence: Synthetic oligonucleotide
acaaagtgcttccctttagagt

SEQ ID NO: 3869 - DNA, 21 bp, Artificial Sequence
  Description of Artificial Sequence: Synthetic oligonucleotide
agaattgcgtttggacaatca

SEQ ID NO: 3870 - DNA, 21 bp, Artificial Sequence
  Description of Artificial Sequence: Synthetic oligonucleotide
tgattgtccaaacgcaattct

SEQ ID NO: 3871 - DNA, 22 bp, Artificial Sequence
  Description of Artificial Sequence: Synthetic oligonucleotide
cagtggttttaccctatggtag

SEQ ID NO: 3872 - DNA, 23 bp, Artificial Sequence
  Description of Artificial Sequence: Synthetic oligonucleotide
tgaggggcagagagcgagacttt

SEQ ID NO: 3873 - DNA, 22 bp, Artificial Sequence
  Description of Artificial Sequence: Synthetic oligonucleotide
gaagtaaacatccacctcccag

SEQ ID NO: 3874 - DNA, 21 bp, Artificial Sequence
  Description of Artificial Sequence: Synthetic oligonucleotide
gccaatatttctgtgctgcta

SEQ ID NO: 3875 - DNA, 22 bp, Artificial Sequence
  Description of Artificial Sequence: Synthetic oligonucleotide
tccacatggagttgctgttaca

SEQ ID NO: 3876 - DNA, 22 bp, Artificial Sequence
  Description of Artificial Sequence: Synthetic oligonucleotide
tccacatggagttgctgttaca

SEQ ID NO: 3877 - DNA, 22 bp, Artificial Sequence
  Description of Artificial Sequence: Synthetic oligonucleotide
ttcaccaccttctccacccagc

SEQ ID NO: 3878 - DNA, 23 bp, Artificial Sequence
  Description of Artificial Sequence: Synthetic oligonucleotide
cagctgcttttgggattccgttg

SEQ ID NO: 3879 - DNA, 22 bp, Artificial Sequence
  Description of Artificial Sequence: Synthetic oligonucleotide
tgatatgtttgatatattaggt

SEQ ID NO: 3880 - DNA, 21 bp, Artificial Sequence
  Description of Artificial Sequence: Synthetic oligonucleotide
ggctgtcaattcataggtcag

SEQ ID NO: 3881 - DNA, 22 bp, Artificial Sequence
  Description of Artificial Sequence: Synthetic oligonucleotide
accagctaacaatacactgcca

SEQ ID NO: 3882 - DNA, 23 bp, Artificial Sequence
  Description of Artificial Sequence: Synthetic oligonucleotide
cggctctgtcgtcgaggcgctca

SEQ ID NO: 3883 - DNA, 23 bp, Artificial Sequence
  Description of Artificial Sequence: Synthetic oligonucleotide
catgagtgacgccctctggagta

SEQ ID NO: 3884 - DNA, 22 bp, Artificial Sequence
  Description of Artificial Sequence: Synthetic oligonucleotide
gaaaagccagggtctgtataga

SEQ ID NO: 3885 - DNA, 24 bp, Artificial Sequence
  Description of Artificial Sequence: Synthetic oligonucleotide
aatccttggaacctaggtgtgagt

SEQ ID NO: 3886 - DNA, 22 bp, Artificial Sequence
  Description of Artificial Sequence: Synthetic oligonucleotide
acaggtgaggttcttgggagcc

SEQ ID NO: 3887 - DNA, 22 bp, Artificial Sequence
  Description of Artificial Sequence: Synthetic oligonucleotide
agggcagtatacttgctgattg

SEQ ID NO: 3888 - DNA, 23 bp, Artificial Sequence
  Description of Artificial Sequence: Synthetic oligonucleotide
gaagtgcttcgattttggggtgt

SEQ ID NO: 3889 - DNA, 22 bp, Artificial Sequence
  Description of Artificial Sequence: Synthetic oligonucleotide
aatgcacctgggcaaggattca

SEQ ID NO: 3890 - DNA, 22 bp, Artificial Sequence
  Description of Artificial Sequence: Synthetic oligonucleotide
taatactgcctggtaatgatga

SEQ ID NO: 3891 - DNA, 23 bp, Artificial Sequence
  Description of Artificial Sequence: Synthetic oligonucleotide
taatactgccgggtaatgatgga

SEQ ID NO: 3892 - DNA, 22 bp, Artificial Sequence
  Description of Artificial Sequence: Synthetic oligonucleotide
taacactgtctggtaacgatgt

SEQ ID NO: 3893 - DNA, 21 bp, Artificial Sequence
  Description of Artificial Sequence: Synthetic oligonucleotide
aatataacacagatggcctgt

SEQ ID NO: 3894 - DNA, 21 bp, Artificial Sequence
  Description of Artificial Sequence: Synthetic oligonucleotide
tagtagaccgtatagcgtacg

SEQ ID NO: 3895 - DNA, 23 bp, Artificial Sequence
  Description of Artificial Sequence: Synthetic oligonucleotide
acttcacctggtccactagccgt

SEQ ID NO: 3896 - DNA, 21 bp, Artificial Sequence
  Description of Artificial Sequence: Synthetic oligonucleotide
atcagaggttcagcttaccct

SEQ ID NO: 3897 - DNA, 21 bp, Artificial Sequence
  Description of Artificial Sequence: Synthetic oligonucleotide
gctagtcctgactcagccagt

SEQ ID NO: 3898 - DNA, 22 bp, Artificial Sequence
  Description of Artificial Sequence: Synthetic oligonucleotide
ttgtacatggtaggctttcatt

SEQ ID NO: 3899 - DNA, 23 bp, Artificial Sequence
  Description of Artificial Sequence: Synthetic oligonucleotide
agtgcctgagggagtaagagccc

SEQ ID NO: 3900 - DNA, 23 bp, Artificial Sequence
  Description of Artificial Sequence: Synthetic oligonucleotide
agtgcctgagggagtaagagccc

SEQ ID NO: 3901 - DNA, 21 bp, Artificial Sequence
  Description of Artificial Sequence: Synthetic oligonucleotide
aaaacggtgagattttgtttt

SEQ ID NO: 3902 - DNA, 22 bp, Artificial Sequence
  Description of Artificial Sequence: Synthetic oligonucleotide
tgggtctttgcgggcgagatga

SEQ ID NO: 3903 - DNA, 22 bp, Artificial Sequence
  Description of Artificial Sequence: Synthetic oligonucleotide
tgaattactttgtaaaccacca

SEQ ID NO: 3904 - DNA, 22 bp, Artificial Sequence
  Description of Artificial Sequence: Synthetic oligonucleotide
actccaacagggccgcgtctcc

SEQ ID NO: 3905 - DNA, 22 bp, Artificial Sequence
  Description of Artificial Sequence: Synthetic oligonucleotide
cttccagtcgaggatgtttaca

SEQ ID NO: 3906 - DNA, 22 bp, Artificial Sequence
  Description of Artificial Sequence: Synthetic oligonucleotide
agctgagtgtaggatgtttaca

SEQ ID NO: 3907 - DNA, 23 bp, Artificial Sequence
  Description of Artificial Sequence: Synthetic oligonucleotide
tgtaaacatcctacactctcagc

SEQ ID NO: 3908 - DNA, 23 bp, Artificial Sequence
  Description of Artificial Sequence: Synthetic oligonucleotide
gctgagagtgtaggatgtttaca

SEQ ID NO: 3909 - DNA, 22 bp, Artificial Sequence
  Description of Artificial Sequence: Synthetic oligonucleotide
cttccagtcggggatgtttaca

SEQ ID NO: 3910 - DNA, 22 bp, Artificial Sequence
  Description of Artificial Sequence: Synthetic oligonucleotide
tgtaaacatccttgactggaag

SEQ ID NO: 3911 - DNA, 22 bp, Artificial Sequence
  Description of Artificial Sequence: Synthetic oligonucleotide
aatgataatacaacctgctaag

SEQ ID NO: 3912 - DNA, 22 bp, Artificial Sequence
  Description of Artificial Sequence: Synthetic oligonucleotide
acaaaagcaactgaggttcttg

SEQ ID NO: 3913 - DNA, 24 bp, Artificial Sequence
  Description of Artificial Sequence: Synthetic oligonucleotide
ttctccaaaagaaagcactttctg

SEQ ID NO: 3914 - DNA, 24 bp, Artificial Sequence
  Description of Artificial Sequence: Synthetic oligonucleotide
ttctccaaaagaaagcactttctg

SEQ ID NO: 3915 - DNA, 22 bp, Artificial Sequence
  Description of Artificial Sequence: Synthetic oligonucleotide
taatactgtctggtaaaaccgt

SEQ ID NO: 3916 - DNA, 22 bp, Artificial Sequence
  Description of Artificial Sequence: Synthetic oligonucleotide
tcctgtactgagctgccccgag

SEQ ID NO: 3917 - DNA, 22 bp, Artificial Sequence
  Description of Artificial Sequence: Synthetic oligonucleotide
ctcggggcagctcagtacagga

SEQ ID NO: 3918 - DNA, 21 bp, Artificial Sequence
  Description of Artificial Sequence: Synthetic oligonucleotide
tgttcatgtagatgtttaagc

SEQ ID NO: 3919 - DNA, 22 bp, Artificial Sequence
  Description of Artificial Sequence: Synthetic oligonucleotide
aacccgtagatccgatcttgtg

SEQ ID NO: 3920 - DNA, 21 bp, Artificial Sequence
  Description of Artificial Sequence: Synthetic oligonucleotide
ctcccacatgcagggtttgca

SEQ ID NO: 3921 - DNA, 22 bp, Artificial Sequence
  Description of Artificial Sequence: Synthetic oligonucleotide
cacccgtagaaccgaccttgcg

SEQ ID NO: 3922 - DNA, 22 bp, Artificial Sequence
  Description of Artificial Sequence: Synthetic oligonucleotide
tatacaagggcagactctctct

SEQ ID NO: 3923 - DNA, 22 bp, Artificial Sequence
  Description of Artificial Sequence: Synthetic oligonucleotide
aactggccctcaaagtcccgct

SEQ ID NO: 3924 - DNA, 21 bp, Artificial Sequence
  Description of Artificial Sequence: Synthetic oligonucleotide
gagctgcatcctggctccggg

SEQ ID NO: 3925 - DNA, 22 bp, Artificial Sequence
  Description of Artificial Sequence: Synthetic oligonucleotide
ctgggagagggttgtttactcc

SEQ ID NO: 3926 - DNA, 22 bp, Artificial Sequence
  Description of Artificial Sequence: Synthetic oligonucleotide
tgaaatgcaaacctgcaaaact

SEQ ID NO: 3927 - DNA, 21 bp, Artificial Sequence
  Description of Artificial Sequence: Synthetic oligonucleotide
agggctcatcttggtcctgca

SEQ ID NO: 3928 - DNA, 21 bp, Artificial Sequence
  Description of Artificial Sequence: Synthetic oligonucleotide
gcaaggcagtggcctgtacag

SEQ ID NO: 3929 - DNA, 23 bp, Artificial Sequence
  Description of Artificial Sequence: Synthetic oligonucleotide
aaatcagaatcacacctggggga

SEQ ID NO: 3930 - DNA, 20 bp, Artificial Sequence
  Description of Artificial Sequence: Synthetic oligonucleotide
ctgcaaagggaagccctttc

SEQ ID NO: 3931 - DNA, 20 bp, Artificial Sequence
  Description of Artificial Sequence: Synthetic oligonucleotide
ctgcaaagggaagccctttc

SEQ ID NO: 3932 - DNA, 19 bp, Artificial Sequence
  Description of Artificial Sequence: Synthetic oligonucleotide
gtcctgaattccgcagcct

SEQ ID NO: 3933 - DNA, 22 bp, Artificial Sequence
  Description of Artificial Sequence: Synthetic oligonucleotide
agaggctggccgtgatgaattc

SEQ ID NO: 3934 - DNA, 22 bp, Artificial Sequence
  Description of Artificial Sequence: Synthetic oligonucleotide
cacttacttctttgcagatgag

SEQ ID NO: 3935 - DNA, 22 bp, Artificial Sequence
  Description of Artificial Sequence: Synthetic oligonucleotide
tattcaggaacatattgcaaaa

SEQ ID NO: 3936 - DNA, 22 bp, Artificial Sequence
  Description of Artificial Sequence: Synthetic oligonucleotide
aggaaaccagcaagtgttgacg

SEQ ID NO: 3937 - DNA, 22 bp, Artificial Sequence
  Description of Artificial Sequence: Synthetic oligonucleotide
tggtttaccgtcccacatacat

SEQ ID NO: 3938 - DNA, 22 bp, Artificial Sequence
  Description of Artificial Sequence: Synthetic oligonucleotide
accactgaccgttgactgtacc

SEQ ID NO: 3939 - DNA, 22 bp, Artificial Sequence
  Description of Artificial Sequence: Synthetic oligonucleotide
ctaagccaccatgtgaaaccag

SEQ ID NO: 3940 - DNA, 21 bp, Artificial Sequence
  Description of Artificial Sequence: Synthetic oligonucleotide
cacattacacggtcgacctct

SEQ ID NO: 3941 - DNA, 22 bp, Artificial Sequence
  Description of Artificial Sequence: Synthetic oligonucleotide
agctagtgagaagtcaatgcct

SEQ ID NO: 3942 - DNA, 22 bp, Artificial Sequence
  Description of Artificial Sequence: Synthetic oligonucleotide
cttacagtatatgatgatatcc

SEQ ID NO: 3943 - DNA, 17 bp, Artificial Sequence
  Description of Artificial Sequence: Synthetic oligonucleotide
tcccaccgctgccaccc

SEQ ID NO: 3944 - DNA, 22 bp, Artificial Sequence
  Description of Artificial Sequence: Synthetic oligonucleotide
tatgtaacatggtccactaact

SEQ ID NO: 3945 - DNA, 22 bp, Artificial Sequence
  Description of Artificial Sequence: Synthetic oligonucleotide
agaaggaaattgaattcattta

SEQ ID NO: 3946 - DNA, 23 bp, Artificial Sequence
  Description of Artificial Sequence: Synthetic oligonucleotide
acaccaatgccctaggggatgcg

SEQ ID NO: 3947 - DNA, 18 bp, Artificial Sequence
  Description of Artificial Sequence: Synthetic oligonucleotide
tgcttcctttcagagggt

SEQ ID NO: 3948 - DNA, 18 bp, Artificial Sequence
  Description of Artificial Sequence: Synthetic oligonucleotide
tgcttcctttcagagggt

SEQ ID NO: 3949 - DNA, 23 bp, Artificial Sequence
  Description of Artificial Sequence: Synthetic oligonucleotide
ctaactgcactagatgcacctta

SEQ ID NO: 3950 - DNA, 23 bp, Artificial Sequence
  Description of Artificial Sequence: Synthetic oligonucleotide
caaagtgcttacagtgcaggtag

SEQ ID NO: 3951 - DNA, 22 bp, Artificial Sequence
  Description of Artificial Sequence: Synthetic oligonucleotide
tagcagcacgtaaatattggcg

SEQ ID NO: 3952 - DNA, 22 bp, Artificial Sequence
  Description of Artificial Sequence: Synthetic oligonucleotide
cgccaatatttacgtgctgcta

SEQ ID NO: 3953 - DNA, 22 bp, Artificial Sequence
  Description of Artificial Sequence: Synthetic oligonucleotide
cctgttctccattacttggctc

SEQ ID NO: 3954 - DNA, 23 bp, Artificial Sequence
  Description of Artificial Sequence: Synthetic oligonucleotide
actcagaaggacaagtagagttt

SEQ ID NO: 3955 - DNA, 21 bp, Artificial Sequence
  Description of Artificial Sequence: Synthetic oligonucleotide
gcccctgggcctatcctagaa

SEQ ID NO: 3956 - DNA, 23 bp, Artificial Sequence
  Description of Artificial Sequence: Synthetic oligonucleotide
taaatcccatggtgccttctcct

SEQ ID NO: 3957 - DNA, 21 bp, Artificial Sequence
  Description of Artificial Sequence: Synthetic oligonucleotide
atcatagaggaaaatccacgt

SEQ ID NO: 3958 - DNA, 21 bp, Artificial Sequence
  Description of Artificial Sequence: Synthetic oligonucleotide
atcatagaggaaaatccacgt

SEQ ID NO: 3959 - DNA, 22 bp, Artificial Sequence
  Description of Artificial Sequence: Synthetic oligonucleotide
atcatagaggaaaatccatgtt

SEQ ID NO: 3960 - DNA, 21 bp, Artificial Sequence
  Description of Artificial Sequence: Synthetic oligonucleotide
aacatagaggaaattccacgt

SEQ ID NO: 3961 - DNA, 22 bp, Artificial Sequence
  Description of Artificial Sequence: Synthetic oligonucleotide
ctcctccaacaatcctagacca

SEQ ID NO: 3962 - DNA, 23 bp, Artificial Sequence
  Description of Artificial Sequence: Synthetic oligonucleotide
gagcaaggctcttgtctgtaagt

SEQ ID NO: 3963 - DNA, 22 bp, Artificial Sequence
  Description of Artificial Sequence: Synthetic oligonucleotide
cacacactgcaattacttttgc

SEQ ID NO: 3964 - DNA, 23 bp, Artificial Sequence
  Description of Artificial Sequence: Synthetic oligonucleotide
gacacgggcgacagctgcggccc

SEQ ID NO: 3965 - DNA, 20 bp, Artificial Sequence
  Description of Artificial Sequence: Synthetic oligonucleotide
agagatgagagaaacaccct

SEQ ID NO: 3966 - DNA, 25 bp, Artificial Sequence
  Description of Artificial Sequence: Synthetic oligonucleotide
aggggtggtgttgggacagctccgt

SEQ ID NO: 3967 - DNA, 22 bp, Artificial Sequence
  Description of Artificial Sequence: Synthetic oligonucleotide
gaaatcaagcgtgggtgagacc

SEQ ID NO: 3968 - DNA, 22 bp, Artificial Sequence
  Description of Artificial Sequence: Synthetic oligonucleotide
attctgcatttttagcaagttc

SEQ ID NO: 3969 - DNA, 24 bp, Artificial Sequence
  Description of Artificial Sequence: Synthetic oligonucleotide
atccaatcattttccctagccagt

SEQ ID NO: 3970 - DNA, 23 bp, Artificial Sequence
  Description of Artificial Sequence: Synthetic oligonucleotide
aggttacccgagcaactttgcat

SEQ ID NO: 3971 - DNA, 22 bp, Artificial Sequence
  Description of Artificial Sequence: Synthetic oligonucleotide
catcatcgtctcaaatgagtct

SEQ ID NO: 3972 - DNA, 20 bp, Artificial Sequence
  Description of Artificial Sequence: Synthetic oligonucleotide
aagcagaaaaaggcaaacga

SEQ ID NO: 3973 - DNA, 22 bp, Artificial Sequence
  Description of Artificial Sequence: Synthetic oligonucleotide
ctctagagggaagcgctttctg

SEQ ID NO: 3974 - DNA, 20 bp, Artificial Sequence
  Description of Artificial Sequence: Synthetic oligonucleotide
tcactgttcagacaggcgga

SEQ ID NO: 3975 - DNA, 20 bp, Artificial Sequence
  Description of Artificial Sequence: Synthetic oligonucleotide
tctgcagggtttgctttgag

SEQ ID NO: 3976 - DNA, 22 bp, Artificial Sequence
  Description of Artificial Sequence: Synthetic oligonucleotide
cctcaggcacggccgggccacc

SEQ ID NO: 3977 - DNA, 24 bp, Artificial Sequence
  Description of Artificial Sequence: Synthetic oligonucleotide
tcagagcatgtgtttaatcaggct

SEQ ID NO: 3978 - DNA, 22 bp, Artificial Sequence
  Description of Artificial Sequence: Synthetic oligonucleotide
gaggctcagaatggctcaggag

SEQ ID NO: 3979 - DNA, 22 bp, Artificial Sequence
  Description of Artificial Sequence: Synthetic oligonucleotide
cactcagcaccaggatattgtt

SEQ ID NO: 3980 - DNA, 21 bp, Artificial Sequence
  Description of Artificial Sequence: Synthetic oligonucleotide
gtgccagctgcagtgggggag

SEQ ID NO: 3981 - DNA, 22 bp, Artificial Sequence
  Description of Artificial Sequence: Synthetic oligonucleotide
aatcctttgtccctgggtgaga

SEQ ID NO: 3982 - DNA, 22 bp, Artificial Sequence
  Description of Artificial Sequence: Synthetic oligonucleotide
ctctagagggaagcgctttctg

SEQ ID NO: 3983 - DNA, 22 bp, Artificial Sequence
  Description of Artificial Sequence: Synthetic oligonucleotide
agcatcagcactgtgataactg

SEQ ID NO: 3984 - DNA, 21 bp, Artificial Sequence
  Description of Artificial Sequence: Synthetic oligonucleotide
gtgtcttttgctctgcagtca

SEQ ID NO: 3985 - DNA, 21 bp, Artificial Sequence
  Description of Artificial Sequence: Synthetic oligonucleotide
gtgtcttttgctctgcagtca

SEQ ID NO: 3986 - DNA, 22 bp, Artificial Sequence
  Description of Artificial Sequence: Synthetic oligonucleotide
gtgattgccactctcctgagta

SEQ ID NO: 3987 - DNA, 21 bp, Artificial Sequence
  Description of Artificial Sequence: Synthetic oligonucleotide
ctatacaatctactgtctttc

SEQ ID NO: 3988 - DNA, 21 bp, Artificial Sequence
  Description of Artificial Sequence: Synthetic oligonucleotide
ctatacaatctactgtctttc

SEQ ID NO: 3989 - DNA, 21 bp, Artificial Sequence
  Description of Artificial Sequence: Synthetic oligonucleotide
tctactcacagaagtgtcaat

SEQ ID NO: 3990 - DNA, 21 bp, Artificial Sequence
  Description of Artificial Sequence: Synthetic oligonucleotide
tctactcacagaagtgtcaat

SEQ ID NO: 3991 - DNA, 21 bp, Artificial Sequence
  Description of Artificial Sequence: Synthetic oligonucleotide
tctactcacagaagtgtcaat

SEQ ID NO: 3992 - DNA, 21 bp, Artificial Sequence
  Description of Artificial Sequence: Synthetic oligonucleotide
gaaggcgcttccctttggagt

SEQ ID NO: 3993 - DNA, 22 bp, Artificial Sequence
  Description of Artificial Sequence: Synthetic oligonucleotide
agtggggaacccttccatgagg

SEQ ID NO: 3994 - DNA, 22 bp, Artificial Sequence
  Description of Artificial Sequence: Synthetic oligonucleotide
gccagaaggggcatttagggca

SEQ ID NO: 3995 - DNA, 22 bp, Artificial Sequence
  Description of Artificial Sequence: Synthetic oligonucleotide
tatgtaacacggtccactaacc

SEQ ID NO: 3996 - DNA, 22 bp, Artificial Sequence
  Description of Artificial Sequence: Synthetic oligonucleotide
gcaaaagaaactgtggtttttg

SEQ ID NO: 3997 - DNA, 22 bp, Artificial Sequence
  Description of Artificial Sequence: Synthetic oligonucleotide
gcaaaagaaactgtggtttttg

SEQ ID NO: 3998 - DNA, 22 bp, Artificial Sequence
  Description of Artificial Sequence: Synthetic oligonucleotide
caacctggaggactccatgctg

SEQ ID NO: 3999 - DNA, 22 bp, Artificial Sequence
  Description of Artificial Sequence: Synthetic oligonucleotide
aagatgtggaaaaattggaatc

SEQ ID NO: 4000 - DNA, 22 bp, Artificial Sequence
  Description of Artificial Sequence: Synthetic oligonucleotide
acaaccagctaagacactgcca

SEQ ID NO: 4001 - DNA, 22 bp, Artificial Sequence
  Description of Artificial Sequence: Synthetic oligonucleotide
caatcactaactccactgccat

SEQ ID NO: 4002 - DNA, 22 bp, Artificial Sequence
  Description of Artificial Sequence: Synthetic oligonucleotide
tggtgggccgcagaacatgtgc

SEQ ID NO: 4003 - DNA, 22 bp, Artificial Sequence
  Description of Artificial Sequence: Synthetic oligonucleotide
tcacagttgccagctgagatta

SEQ ID NO: 4004 - DNA, 22 bp, Artificial Sequence
  Description of Artificial Sequence: Synthetic oligonucleotide
tcacatttgcctgcagagattt

SEQ ID NO: 4005 - DNA, 21 bp, Artificial Sequence
  Description of Artificial Sequence: Synthetic oligonucleotide
taattttatgtataagctagt

SEQ ID NO: 4006 - DNA, 24 bp, Artificial Sequence
  Description of Artificial Sequence: Synthetic oligonucleotide
cacccccagagcctcagctcccca

SEQ ID NO: 4007 - DNA, 22 bp, Artificial Sequence
  Description of Artificial Sequence: Synthetic oligonucleotide
actgggttcacctttaagggca

SEQ ID NO: 4008 - DNA, 23 bp, Artificial Sequence
  Description of Artificial Sequence: Synthetic oligonucleotide
aggcagtgtagttagctgattgc

SEQ ID NO: 4009 - DNA, 22 bp, Artificial Sequence
  Description of Artificial Sequence: Synthetic oligonucleotide
tgaggcagcacaatatggcctg

SEQ ID NO: 4010 - DNA, 22 bp, Artificial Sequence
  Description of Artificial Sequence: Synthetic oligonucleotide
gggagaggtctccctgcgcaca

SEQ ID NO: 4011 - DNA, 22 bp, Artificial Sequence
  Description of Artificial Sequence: Synthetic oligonucleotide
aacatcacagcaagtctgtgct

SEQ ID NO: 4012 - DNA, 22 bp, Artificial Sequence
  Description of Artificial Sequence: Synthetic oligonucleotide
ggcagagagtcagagcgcggat

SEQ ID NO: 4013 - DNA, 22 bp, Artificial Sequence
  Description of Artificial Sequence: Synthetic oligonucleotide
ctgcgattcctccctctactgt

SEQ ID NO: 4014 - DNA, 23 bp, Artificial Sequence
  Description of Artificial Sequence: Synthetic oligonucleotide
ccagttaccgcttccgctaccgc

SEQ ID NO: 4015 - DNA, 22 bp, Artificial Sequence
  Description of Artificial Sequence: Synthetic oligonucleotide
tatgtctgctgaccatcacctt

SEQ ID NO: 4016 - DNA, 22 bp, Artificial Sequence
  Description of Artificial Sequence: Synthetic oligonucleotide
cgggaagtgctagctcagcagt

SEQ ID NO: 4017 - DNA, 22 bp, Artificial Sequence
  Description of Artificial Sequence: Synthetic oligonucleotide
atctggaggtaagaagcacttt

SEQ ID NO: 4018 - DNA, 22 bp, Artificial Sequence
  Description of Artificial Sequence: Synthetic oligonucleotide
atctggaggtaagaagcacttt

SEQ ID NO: 4019 - DNA, 21 bp, Artificial Sequence
  Description of Artificial Sequence: Synthetic oligonucleotide
tggaaaccaagagtgggtcgc

SEQ ID NO: 4020 - DNA, 21 bp, Artificial Sequence
  Description of Artificial Sequence: Synthetic oligonucleotide
gcgacccatacttggtttcag

SEQ ID NO: 4021 - DNA, 22 bp, Artificial Sequence
  Description of Artificial Sequence: Synthetic oligonucleotide
gctgactcctagtccagggctc

SEQ ID NO: 4022 - DNA, 23 bp, Artificial Sequence
  Description of Artificial Sequence: Synthetic oligonucleotide
agaggcaggcatgcgggcagaca

SEQ ID NO: 4023 - DNA, 22 bp, Artificial Sequence
  Description of Artificial Sequence: Synthetic oligonucleotide
aatcagtctcattgctttataa

SEQ ID NO: 4024 - DNA, 23 bp, Artificial Sequence
  Description of Artificial Sequence: Synthetic oligonucleotide
ctacctgcactgtaagcactttt

SEQ ID NO: 4025 - DNA, 22 bp, Artificial Sequence
  Description of Artificial Sequence: Synthetic oligonucleotide
tgggttcctggcatgctgattt

SEQ ID NO: 4026 - DNA, 21 bp, Artificial Sequence
  Description of Artificial Sequence: Synthetic oligonucleotide
atctgcactgtcagcacttta

SEQ ID NO: 4027 - DNA, 22 bp, Artificial Sequence
  Description of Artificial Sequence: Synthetic oligonucleotide
cagataacagcagccccactgg

SEQ ID NO: 4028 - DNA, 22 bp, Artificial Sequence
  Description of Artificial Sequence: Synthetic oligonucleotide
ctctagagggaagcgctttctg

SEQ ID NO: 4029 - DNA, 22 bp, Artificial Sequence
  Description of Artificial Sequence: Synthetic oligonucleotide
aagtgcctccttttagagtgtt

SEQ ID NO: 4030 - DNA, 22 bp, Artificial Sequence
  Description of Artificial Sequence: Synthetic oligonucleotide
caaagtgcctccctttagagtg

SEQ ID NO: 4031 - DNA, 23 bp, Artificial Sequence
  Description of Artificial Sequence: Synthetic oligonucleotide
ctgggatctccggggtcttggtt

SEQ ID NO: 4032 - DNA, 22 bp, Artificial Sequence
  Description of Artificial Sequence: Synthetic oligonucleotide
aaagtgcatccttttagagtgt

SEQ ID NO: 4033 - DNA, 22 bp, Artificial Sequence
  Description of Artificial Sequence: Synthetic oligonucleotide
aaagtgcatccttttagagtgt

SEQ ID NO: 4034 - DNA, 21 bp, Artificial Sequence
  Description of Artificial Sequence: Synthetic oligonucleotide
ctggaggacggcaacagtcag

SEQ ID NO: 4035 - DNA, 21 bp, Artificial Sequence
  Description of Artificial Sequence: Synthetic oligonucleotide
aaggcagggcccccgctcccc

SEQ ID NO: 4036 - DNA, 23 bp, Artificial Sequence
  Description of Artificial Sequence: Synthetic oligonucleotide
cacccggctgtgtgcacatgtgc

SEQ ID NO: 4037 - DNA, 23 bp, Artificial Sequence
  Description of Artificial Sequence: Synthetic oligonucleotide
cacccggctgtgtgcacatgtgc

SEQ ID NO: 4038 - DNA, 23 bp, Artificial Sequence
  Description of Artificial Sequence: Synthetic oligonucleotide
cacccggctgtgtgcacatgtgc

SEQ ID NO: 4039 - DNA, 23 bp, Artificial Sequence
  Description of Artificial Sequence: Synthetic oligonucleotide
agctcggtctgaggcccctcagt

SEQ ID NO: 4040 - DNA, 22 bp, Artificial Sequence
  Description of Artificial Sequence: Synthetic oligonucleotide
gtgaaatgtttaggaccactag

SEQ ID NO: 4041 - DNA, 20 bp, Artificial Sequence
  Description of Artificial Sequence: Synthetic oligonucleotide
ttcccatgccctatacctct

SEQ ID NO: 4042 - DNA, 22 bp, Artificial Sequence
  Description of Artificial Sequence: Synthetic oligonucleotide
tccttcattccaccggagtctg

SEQ ID NO: 4043 - DNA, 22 bp, Artificial Sequence
  Description of Artificial Sequence: Synthetic oligonucleotide
aggcataggatgacaaagggaa

SEQ ID NO: 4044 - DNA, 22 bp, Artificial Sequence
  Description of Artificial Sequence: Synthetic oligonucleotide
ctctagagggaagcactttctg

SEQ ID NO: 4045 - DNA, 22 bp, Artificial Sequence
  Description of Artificial Sequence: Synthetic oligonucleotide
ctctagagggaagcactttctg

SEQ ID NO: 4046 - DNA, 22 bp, Artificial Sequence
  Description of Artificial Sequence: Synthetic oligonucleotide
cactagattgtgagctcctgga

SEQ ID NO: 4047 - DNA, 23 bp, Artificial Sequence
  Description of Artificial Sequence: Synthetic oligonucleotide
agcaagtacatccacgtttaagt

SEQ ID NO: 4048 - DNA, 22 bp, Artificial Sequence
  Description of Artificial Sequence: Synthetic oligonucleotide
caaaaatctcaattacttttgc

SEQ ID NO: 4049 - DNA, 21 bp, Artificial Sequence
  Description of Artificial Sequence: Synthetic oligonucleotide
atagcagcgcctcacgttttg

SEQ ID NO: 4050 - DNA, 23 bp, Artificial Sequence
  Description of Artificial Sequence: Synthetic oligonucleotide
ccgcttgagctaactccgacccg

SEQ ID NO: 4051 - DNA, 21 bp, Artificial Sequence
  Description of Artificial Sequence: Synthetic oligonucleotide
tcctcttctccctcctcccag

SEQ ID NO: 4052 - DNA, 23 bp, Artificial Sequence
  Description of Artificial Sequence: Synthetic oligonucleotide
aacactgatttcaaatggtgcta

SEQ ID NO: 4053 - DNA, 23 bp, Artificial Sequence
  Description of Artificial Sequence: Synthetic oligonucleotide
aacactgatttcaaatggtgcta

SEQ ID NO: 4054 - DNA, 22 bp, Artificial Sequence
  Description of Artificial Sequence: Synthetic oligonucleotide
taaccgatttcaaatggtgcta

SEQ ID NO: 4055 - DNA, 22 bp, Artificial Sequence
  Description of Artificial Sequence: Synthetic oligonucleotide
taaccgatttcagatggtgcta

SEQ ID NO: 4056 - DNA, 23 bp, Artificial Sequence
  Description of Artificial Sequence: Synthetic oligonucleotide
taaagtgcttatagtgcaggtag

SEQ ID NO: 4057 - DNA, 21 bp, Artificial Sequence
  Description of Artificial Sequence: Synthetic oligonucleotide
atgatccaggaacctgcctct

SEQ ID NO: 4058 - DNA, 21 bp, Artificial Sequence
  Description of Artificial Sequence: Synthetic oligonucleotide
ctttttgcggtctgggcttgc

SEQ ID NO: 4059 - DNA, 21 bp, Artificial Sequence
  Description of Artificial Sequence: Synthetic oligonucleotide
ctttttgcggtctgggcttgc

SEQ ID NO: 4060 - DNA, 23 bp, Artificial Sequence
  Description of Artificial Sequence: Synthetic oligonucleotide
ctacctgcactatgagcactttg

SEQ ID NO: 4061 - DNA, 19 bp, Artificial Sequence
  Description of Artificial Sequence: Synthetic oligonucleotide
tctaggctggtactgctga

SEQ ID NO: 4062 - DNA, 19 bp, Artificial Sequence
  Description of Artificial Sequence: Synthetic oligonucleotide
agtgtggctttcttagagc

SEQ ID NO: 4063 - DNA, 21 bp, Artificial Sequence
  Description of Artificial Sequence: Synthetic oligonucleotide
gaaggaagtgagtgcagccac

SEQ ID NO: 4064 - DNA, 19 bp, Artificial Sequence
  Description of Artificial Sequence: Synthetic oligonucleotide
aagcagctgcctctgaggc

SEQ ID NO: 4065 - DNA, 22 bp, Artificial Sequence
  Description of Artificial Sequence: Synthetic oligonucleotide
gactcttgaacaacacaggttt

SEQ ID NO: 4066 - DNA, 19 bp, Artificial Sequence
  Description of Artificial Sequence: Synthetic oligonucleotide
accagtgccctgcacactt

SEQ ID NO: 4067 - DNA, 20 bp, Artificial Sequence
  Description of Artificial Sequence: Synthetic oligonucleotide
cggctctgggtctgtgggga

SEQ ID NO: 4068 - DNA, 22 bp, Artificial Sequence
  Description of Artificial Sequence: Synthetic oligonucleotide
gctgaggctgtggggctggagt

SEQ ID NO: 4069 - DNA, 21 bp, Artificial Sequence
  Description of Artificial Sequence: Synthetic oligonucleotide
catcaccttccttctcctcca

SEQ ID NO: 4070 - DNA, 21 bp, Artificial Sequence
  Description of Artificial Sequence: Synthetic oligonucleotide
tcgactgccactcttactaga

SEQ ID NO: 4071 - DNA, 21 bp, Artificial Sequence
  Description of Artificial Sequence: Synthetic oligonucleotide
gaacggcttcatacaggagtt

SEQ ID NO: 4072 - DNA, 22 bp, Artificial Sequence
  Description of Artificial Sequence: Synthetic oligonucleotide
actcaaaatgggggcgctttcc

SEQ ID NO: 4073 - DNA, 22 bp, Artificial Sequence
  Description of Artificial Sequence: Synthetic oligonucleotide
agatcgaccgtgttatattcgc

SEQ ID NO: 4074 - DNA, 22 bp, Artificial Sequence
  Description of Artificial Sequence: Synthetic oligonucleotide
aggtctcactttgttgcccaga

SEQ ID NO: 4075 - DNA, 22 bp, Artificial Sequence
  Description of Artificial Sequence: Synthetic oligonucleotide
aggtctcactttgttgcccaga

SEQ ID NO: 4076 - DNA, 22 bp, Artificial Sequence
  Description of Artificial Sequence: Synthetic oligonucleotide
aggatctacactggctactgag

SEQ ID NO: 4077 - DNA, 24 bp, Artificial Sequence
  Description of Artificial Sequence: Synthetic oligonucleotide
tgggagaacctccctgcttctgct

SEQ ID NO: 4078 - DNA, 22 bp, Artificial Sequence
  Description of Artificial Sequence: Synthetic oligonucleotide
tggaatgtaaggaagtgtgtgg

SEQ ID NO: 4079 - DNA, 21 bp, Artificial Sequence
  Description of Artificial Sequence: Synthetic oligonucleotide
catgcacatgcacacatacat

SEQ ID NO: 4080 - DNA, 24 bp, Artificial Sequence
  Description of Artificial Sequence: Synthetic oligonucleotide
tctgggaaccggcatttgttctga

SEQ ID NO: 4081 - DNA, 22 bp, Artificial Sequence
  Description of Artificial Sequence: Synthetic oligonucleotide
cgtgttcacagcggaccttgat

SEQ ID NO: 4082 - DNA, 22 bp, Artificial Sequence
  Description of Artificial Sequence: Synthetic oligonucleotide
atcaaggtccgctgtgaacacg

SEQ ID NO: 4083 - DNA, 22 bp, Artificial Sequence
  Description of Artificial Sequence: Synthetic oligonucleotide
cgtgttcacagcggaccttgat

SEQ ID NO: 4084 - DNA, 22 bp, Artificial Sequence
  Description of Artificial Sequence: Synthetic oligonucleotide
aggggctggctttcctctggtc

SEQ ID NO: 4085 - DNA, 21 bp, Artificial Sequence
  Description of Artificial Sequence: Synthetic oligonucleotide
cggggcagctcagtacaggat

SEQ ID NO: 4086 - DNA, 21 bp, Artificial Sequence
  Description of Artificial Sequence: Synthetic oligonucleotide
atcctgtactgagctgccccg

SEQ ID NO: 4087 - DNA, 22 bp, Artificial Sequence
  Description of Artificial Sequence: Synthetic oligonucleotide
aactggatcaattataggagtg

SEQ ID NO: 4088 - DNA, 22 bp, Artificial Sequence
  Description of Artificial Sequence: Synthetic oligonucleotide
aagtcactgaagggttttgagt

SEQ ID NO: 4089 - DNA, 21 bp, Artificial Sequence
  Description of Artificial Sequence: Synthetic oligonucleotide
aagtgatctaaaggcctacat

SEQ ID NO: 4090 - DNA, 26 bp, Artificial Sequence
  Description of Artificial Sequence: Synthetic oligonucleotide
aagtagttggtttgtatgagatggtt

SEQ ID NO: 4091 - DNA, 26 bp, Artificial Sequence
  Description of Artificial Sequence: Synthetic oligonucleotide
aaccatctcatacaaaccaactactt

SEQ ID NO: 4092 - DNA, 26 bp, Artificial Sequence
  Description of Artificial Sequence: Synthetic oligonucleotide
aagtagttggtttgtatgagatggtt

SEQ ID NO: 4093 - DNA, 26 bp, Artificial Sequence
  Description of Artificial Sequence: Synthetic oligonucleotide
aagtagttggtttgtatgagatggtt

SEQ ID NO: 4094 - DNA, 22 bp, Artificial Sequence
  Description of Artificial Sequence: Synthetic oligonucleotide
tccggggacgaacgggacgggt

SEQ ID NO: 4095 - DNA, 19 bp, Artificial Sequence
  Description of Artificial Sequence: Synthetic oligonucleotide
cctgctccaaaaatccatt

SEQ ID NO: 4096 - DNA, 22 bp, Artificial Sequence
  Description of Artificial Sequence: Synthetic oligonucleotide
tgaagaagggggggaagggcgt

SEQ ID NO: 4097 - DNA, 22 bp, Artificial Sequence
  Description of Artificial Sequence: Synthetic oligonucleotide
cttatgcaagattcccttctac

SEQ ID NO: 4098 - DNA, 22 bp, Artificial Sequence
  Description of Artificial Sequence: Synthetic oligonucleotide
agtcggagtgtctcagaacttt

SEQ ID NO: 4099 - DNA, 22 bp, Artificial Sequence
  Description of Artificial Sequence: Synthetic oligonucleotide
agggacgggacgcggtgcagtg

SEQ ID NO: 4100 - DNA, 22 bp, Artificial Sequence
  Description of Artificial Sequence: Synthetic oligonucleotide
gcaaaagtaactgcagttttgg

SEQ ID NO: 4101 - DNA, 22 bp, Artificial Sequence
  Description of Artificial Sequence: Synthetic oligonucleotide
tcaatgactcaggtaagttgca

SEQ ID NO: 4102 - DNA, 21 bp, Artificial Sequence
  Description of Artificial Sequence: Synthetic oligonucleotide
caaaaaccacaaatacctttg

SEQ ID NO: 4103 - DNA, 22 bp, Artificial Sequence
  Description of Artificial Sequence: Synthetic oligonucleotide
gacaaaacccgcaaatactttt

SEQ ID NO: 4104 - DNA, 22 bp, Artificial Sequence
  Description of Artificial Sequence: Synthetic oligonucleotide
aaaagtacttgcggattttgct

SEQ ID NO: 4105 - DNA, 22 bp, Artificial Sequence
  Description of Artificial Sequence: Synthetic oligonucleotide
tctacaaaggaaagcgctttct

SEQ ID NO: 4106 - DNA, 22 bp, Artificial Sequence
  Description of Artificial Sequence: Synthetic oligonucleotide
tctacaaaggaaagcgctttct

SEQ ID NO: 4107 - DNA, 22 bp, Artificial Sequence
  Description of Artificial Sequence: Synthetic oligonucleotide
ggcaaaatccgcaattactttt

SEQ ID NO: 4108 - DNA, 22 bp, Artificial Sequence
  Description of Artificial Sequence: Synthetic oligonucleotide
ggcaaaatccgcaattactttt

SEQ ID NO: 4109 - DNA, 22 bp, Artificial Sequence
  Description of Artificial Sequence: Synthetic oligonucleotide
ggcaaaatccgcaattactttt

SEQ ID NO: 4110 - DNA, 22 bp, Artificial Sequence
  Description of Artificial Sequence: Synthetic oligonucleotide
ggcaaaatccgcaattactttt

SEQ ID NO: 4111 - DNA, 22 bp, Artificial Sequence
  Description of Artificial Sequence: Synthetic oligonucleotide
gacaaaaaccgcgattactttt

SEQ ID NO: 4112 - DNA, 22 bp, Artificial Sequence
  Description of Artificial Sequence: Synthetic oligonucleotide
gacaaaaaccgcgattactttt

SEQ ID NO: 4113 - DNA, 22 bp, Artificial Sequence
  Description of Artificial Sequence: Synthetic oligonucleotide
gacaaaaaccgcgattactttt

SEQ ID NO: 4114 - DNA, 22 bp, Artificial Sequence
  Description of Artificial Sequence: Synthetic oligonucleotide
gacaaaaaccgcgattactttt

SEQ ID NO: 4115 - DNA, 22 bp, Artificial Sequence
  Description of Artificial Sequence: Synthetic oligonucleotide
gtacaaaagtaattacagtttt

SEQ ID NO: 4116 - DNA, 19 bp, Artificial Sequence
  Description of Artificial Sequence: Synthetic oligonucleotide
aaaagtaattacagttttt

SEQ ID NO: 4117 - DNA, 19 bp, Artificial Sequence
  Description of Artificial Sequence: Synthetic oligonucleotide
aaaagtaattacagttttt

SEQ ID NO: 4118 - DNA, 19 bp, Artificial Sequence
  Description of Artificial Sequence: Synthetic oligonucleotide
aaaagtaattacagttttt

SEQ ID NO: 4119 - DNA, 19 bp, Artificial Sequence
  Description of Artificial Sequence: Synthetic oligonucleotide
aaaagtaattacagttttt

SEQ ID NO: 4120 - DNA, 19 bp, Artificial Sequence
  Description of Artificial Sequence: Synthetic oligonucleotide
aaaagtaattacagttttt

SEQ ID NO: 4121 - DNA, 22 bp, Artificial Sequence
  Description of Artificial Sequence: Synthetic oligonucleotide
tgagtattacatggccaatctc

SEQ ID NO: 4122 - DNA, 21 bp, Artificial Sequence
  Description of Artificial Sequence: Synthetic oligonucleotide
acaaaccacagtgtgctgctg

SEQ ID NO: 4123 - DNA, 21 bp, Artificial Sequence
  Description of Artificial Sequence: Synthetic oligonucleotide
aacccaatatcaaacatatca

SEQ ID NO: 4124 - DNA, 23 bp, Artificial Sequence
  Description of Artificial Sequence: Synthetic oligonucleotide
aggacctgcgggacaagattctt

SEQ ID NO: 4125 - DNA, 22 bp, Artificial Sequence
  Description of Artificial Sequence: Synthetic oligonucleotide
tgaaggtctactgtgtgccagg

SEQ ID NO: 4126 - DNA, 23 bp, Artificial Sequence
  Description of Artificial Sequence: Synthetic oligonucleotide
gaacagatagtctaaacactggg

SEQ ID NO: 4127 - DNA, 22 bp, Artificial Sequence
  Description of Artificial Sequence: Synthetic oligonucleotide
tcagtggctcaggttcgttgca

SEQ ID NO: 4128 - DNA, 22 bp, Artificial Sequence
  Description of Artificial Sequence: Synthetic oligonucleotide
atgcacctgggcaaggattctg

SEQ ID NO: 4129 - DNA, 22 bp, Artificial Sequence
  Description of Artificial Sequence: Synthetic oligonucleotide
tagcacatgctcaaacatccgt

SEQ ID NO: 4130 - DNA, 22 bp, Artificial Sequence
  Description of Artificial Sequence: Synthetic oligonucleotide
tagcacatgctcaaacatccgt

SEQ ID NO: 4131 - DNA, 22 bp, Artificial Sequence
  Description of Artificial Sequence: Synthetic oligonucleotide
ataaacgacacctccttgagaa

SEQ ID NO: 4132 - DNA, 22 bp, Artificial Sequence
  Description of Artificial Sequence: Synthetic oligonucleotide
ataaatgacacctccttgtgaa

SEQ ID NO: 4133 - DNA, 23 bp, Artificial Sequence
  Description of Artificial Sequence: Synthetic oligonucleotide
actgccctaagtgctccttctgg

SEQ ID NO: 4134 - DNA, 22 bp, Artificial Sequence
  Description of Artificial Sequence: Synthetic oligonucleotide
aaagtaactgcagtttttgcta

SEQ ID NO: 4135 - DNA, 22 bp, Artificial Sequence
  Description of Artificial Sequence: Synthetic oligonucleotide
tgcctactgagctgatatcagt

SEQ ID NO: 4136 - DNA, 23 bp, Artificial Sequence
  Description of Artificial Sequence: Synthetic oligonucleotide
agtaactggttgaacaactgtaa

SEQ ID NO: 4137 - DNA, 23 bp, Artificial Sequence
  Description of Artificial Sequence: Synthetic oligonucleotide
tgtcactcggctcggcccactac

SEQ ID NO: 4138 - DNA, 23 bp, Artificial Sequence
  Description of Artificial Sequence: Synthetic oligonucleotide
ttctcgaggaaagaagcactttc

SEQ ID NO: 4139 - DNA, 23 bp, Artificial Sequence
  Description of Artificial Sequence: Synthetic oligonucleotide
ttctcgaggaaagaagcactttc

SEQ ID NO: 4140 - DNA, 22 bp, Artificial Sequence
  Description of Artificial Sequence: Synthetic oligonucleotide
gctgcaaacatccgactgaaag

SEQ ID NO: 4141 - DNA, 22 bp, Artificial Sequence
  Description of Artificial Sequence: Synthetic oligonucleotide
agtgaattctaccagtgccata

SEQ ID NO: 4142 - DNA, 22 bp, Artificial Sequence
  Description of Artificial Sequence: Synthetic oligonucleotide
agcccaaaaggagaattctttg

SEQ ID NO: 4143 - DNA, 22 bp, Artificial Sequence
  Description of Artificial Sequence: Synthetic oligonucleotide
ccggctgcaacacaagacacga

SEQ ID NO: 4144 - DNA, 22 bp, Artificial Sequence
  Description of Artificial Sequence: Synthetic oligonucleotide
tggacggagaactgataagggt

SEQ ID NO: 4145 - DNA, 22 bp, Artificial Sequence
  Description of Artificial Sequence: Synthetic oligonucleotide
tggagagaaaggcagttcctga

SEQ ID NO: 4146 - DNA, 22 bp, Artificial Sequence
  Description of Artificial Sequence: Synthetic oligonucleotide
gaacctatctcccctctggacc

SEQ ID NO: 4147 - DNA, 22 bp, Artificial Sequence
  Description of Artificial Sequence: Synthetic oligonucleotide
tgaggtagtaggttgtgtggtt

SEQ ID NO: 4148 - DNA, 22 bp, Artificial Sequence
  Description of Artificial Sequence: Synthetic oligonucleotide
tatgtgcctttggactacatcg

SEQ ID NO: 4149 - DNA, 23 bp, Artificial Sequence
  Description of Artificial Sequence: Synthetic oligonucleotide
caaagcgcttctctttagagtgt

SEQ ID NO: 4150 - DNA, 23 bp, Artificial Sequence
  Description of Artificial Sequence: Synthetic oligonucleotide
tccagtaccacgtgtcagggcca

SEQ ID NO: 4151 - DNA, 22 bp, Artificial Sequence
  Description of Artificial Sequence: Synthetic oligonucleotide
tatgtaatatggtccacatctt

SEQ ID NO: 4152 - DNA, 22 bp, Artificial Sequence
  Description of Artificial Sequence: Synthetic oligonucleotide
tatacaagggcaagctctctgt

SEQ ID NO: 4153 - DNA, 22 bp, Artificial Sequence
  Description of Artificial Sequence: Synthetic oligonucleotide
gaagttgttcgtggtggattcg

SEQ ID NO: 4154 - DNA, 22 bp, Artificial Sequence
  Description of Artificial Sequence: Synthetic oligonucleotide
agccacaatcaccttctgatct

SEQ ID NO: 4155 - DNA, 20 bp, Artificial Sequence
  Description of Artificial Sequence: Synthetic oligonucleotide
tatgaacaatttctaggaat

SEQ ID NO: 4156 - DNA, 24 bp, Artificial Sequence
  Description of Artificial Sequence: Synthetic oligonucleotide
acgcgcaggccagagacccaggca

SEQ ID NO: 4157 - DNA, 23 bp, Artificial Sequence
  Description of Artificial Sequence: Synthetic oligonucleotide
gcgcccaattaatgtctgttgat

SEQ ID NO: 4158 - DNA, 21 bp, Artificial Sequence
  Description of Artificial Sequence: Synthetic oligonucleotide
gaaagcgcttctctttagagg

SEQ ID NO: 4159 - DNA, 22 bp, Artificial Sequence
  Description of Artificial Sequence: Synthetic oligonucleotide
tacccattgcatatcggagttg

SEQ ID NO: 4160 - DNA, 23 bp, Artificial Sequence
  Description of Artificial Sequence: Synthetic oligonucleotide
tcaacgggagtgatcgtgtcatt

SEQ ID NO: 4161 - DNA, 22 bp, Artificial Sequence
  Description of Artificial Sequence: Synthetic oligonucleotide
ttcaaaacatgaattgctgctg

SEQ ID NO: 4162 - DNA, 23 bp, Artificial Sequence
  Description of Artificial Sequence: Synthetic oligonucleotide
tctctggagggaagcactttctg

SEQ ID NO: 4163 - DNA, 22 bp, Artificial Sequence
  Description of Artificial Sequence: Synthetic oligonucleotide
aaacattcgcggtgcacttctt

SEQ ID NO: 4164 - DNA, 23 bp, Artificial Sequence
  Description of Artificial Sequence: Synthetic oligonucleotide
taaggtgcatctagtgcagatag

SEQ ID NO: 4165 - DNA, 22 bp, Artificial Sequence
  Description of Artificial Sequence: Synthetic oligonucleotide
gctacttcacaacaccagggcc

SEQ ID NO: 4166 - DNA, 22 bp, Artificial Sequence
  Description of Artificial Sequence: Synthetic oligonucleotide
ctatacggcctcctagctttcc

SEQ ID NO: 4167 - DNA, 22 bp, Artificial Sequence
  Description of Artificial Sequence: Synthetic oligonucleotide
gcacacaataaatgtttgctga

SEQ ID NO: 4168 - DNA, 21 bp, Artificial Sequence
  Description of Artificial Sequence: Synthetic oligonucleotide
agagctcatccatagttgtca

SEQ ID NO: 4169 - DNA, 21 bp, Artificial Sequence
  Description of Artificial Sequence: Synthetic oligonucleotide
tgacaactatggatgagctct

SEQ ID NO: 4170 - DNA, 22 bp, Artificial Sequence
  Description of Artificial Sequence: Synthetic oligonucleotide
tttggtccccttcaaccagctg

SEQ ID NO: 4171 - DNA, 22 bp, Artificial Sequence
  Description of Artificial Sequence: Synthetic oligonucleotide
cagctggttgaaggggaccaaa

SEQ ID NO: 4172 - DNA, 22 bp, Artificial Sequence
  Description of Artificial Sequence: Synthetic oligonucleotide
cacgctcatgcacacacccaca

SEQ ID NO: 4173 - DNA, 22 bp, Artificial Sequence
  Description of Artificial Sequence: Synthetic oligonucleotide
tttggtccccttcaaccagcta

SEQ ID NO: 4174 - DNA, 21 bp, Artificial Sequence
  Description of Artificial Sequence: Synthetic oligonucleotide
tccttctgctccgtcccccag

SEQ ID NO: 4175 - DNA, 22 bp, Artificial Sequence
  Description of Artificial Sequence: Synthetic oligonucleotide
agtcttcacaacagccctgtgt

SEQ ID NO: 4176 - DNA, 21 bp, Artificial Sequence
  Description of Artificial Sequence: Synthetic oligonucleotide
aataatacatggttgatcttt

SEQ ID NO: 4177 - DNA, 21 bp, Artificial Sequence
  Description of Artificial Sequence: Synthetic oligonucleotide
aaagcgcttcccttcagagtg

SEQ ID NO: 4178 - DNA, 22 bp, Artificial Sequence
  Description of Artificial Sequence: Synthetic oligonucleotide
ttctccaaaagggagcactttc

SEQ ID NO: 4179 - DNA, 22 bp, Artificial Sequence
  Description of Artificial Sequence: Synthetic oligonucleotide
cacaaaccattatgtgctgcta

SEQ ID NO: 4180 - DNA, 22 bp, Artificial Sequence
  Description of Artificial Sequence: Synthetic oligonucleotide
tgagacctctgggttctgagct

SEQ ID NO: 4181 - DNA, 22 bp, Artificial Sequence
  Description of Artificial Sequence: Synthetic oligonucleotide
tagcagcacatcatggtttaca

SEQ ID NO: 4182 - DNA, 23 bp, Artificial Sequence
  Description of Artificial Sequence: Synthetic oligonucleotide
aggttgtccgtggtgagttcgca

SEQ ID NO: 4183 - DNA, 22 bp, Artificial Sequence
  Description of Artificial Sequence: Synthetic oligonucleotide
tggtgattcacaaagaaatcca

SEQ ID NO: 4184 - DNA, 22 bp, Artificial Sequence
  Description of Artificial Sequence: Synthetic oligonucleotide
tcaccagccctgtgttccctag

SEQ ID NO: 4185 - DNA, 23 bp, Artificial Sequence
  Description of Artificial Sequence: Synthetic oligonucleotide
cagtaacaaagattcatccttgt

SEQ ID NO: 4186 - DNA, 21 bp, Artificial Sequence
  Description of Artificial Sequence: Synthetic oligonucleotide
ctccagagggaagtactttct

SEQ ID NO: 4187 - DNA, 21 bp, Artificial Sequence
  Description of Artificial Sequence: Synthetic oligonucleotide
ttgtctaaccagtcacctgtt

SEQ ID NO: 4188 - DNA, 22 bp, Artificial Sequence
  Description of Artificial Sequence: Synthetic oligonucleotide
gtgtgcggaaatgcttctgcta

SEQ ID NO: 4189 - DNA, 21 bp, Artificial Sequence
  Description of Artificial Sequence: Synthetic oligonucleotide
ctggatggctcctccatgtct

SEQ ID NO: 4190 - DNA, 21 bp, Artificial Sequence
  Description of Artificial Sequence: Synthetic oligonucleotide
aggaggcagcgctctcaggac

SEQ ID NO: 4191 - DNA, 22 bp, Artificial Sequence
  Description of Artificial Sequence: Synthetic oligonucleotide
cctctgaaattcagttcttcag

SEQ ID NO: 4192 - DNA, 23 bp, Artificial Sequence
  Description of Artificial Sequence: Synthetic oligonucleotide
tcaagagcaataacgaaaaatgt

SEQ ID NO: 4193 - DNA, 22 bp, Artificial Sequence
  Description of Artificial Sequence: Synthetic oligonucleotide
aaagtgcttctctttggtgggt

SEQ ID NO: 4194 - DNA, 23 bp, Artificial Sequence
  Description of Artificial Sequence: Synthetic oligonucleotide
agttttgcaggtttgcatccagc

SEQ ID NO: 4195 - DNA, 20 bp, Artificial Sequence
  Description of Artificial Sequence: Synthetic oligonucleotide
gtgtctgggcggacagctgc

SEQ ID NO: 4196 - DNA, 22 bp, Artificial Sequence
  Description of Artificial Sequence: Synthetic oligonucleotide
tgccctgtggactcagttctgg

SEQ ID NO: 4197 - DNA, 22 bp, Artificial Sequence
  Description of Artificial Sequence: Synthetic oligonucleotide
cacctgataaaactgaggtata

SEQ ID NO: 4198 - DNA, 22 bp, Artificial Sequence
  Description of Artificial Sequence: Synthetic oligonucleotide
tcggtccctcgggccagggcag

SEQ ID NO: 4199 - DNA, 21 bp, Artificial Sequence
  Description of Artificial Sequence: Synthetic oligonucleotide
aggagactcacaagttcctgc

SEQ ID NO: 4200 - DNA, 22 bp, Artificial Sequence
  Description of Artificial Sequence: Synthetic oligonucleotide
cgaatcattatttgctgctcta

SEQ ID NO: 4201 - DNA, 21 bp, Artificial Sequence
  Description of Artificial Sequence: Synthetic oligonucleotide
caattgcccaagtctccgcct

SEQ ID NO: 4202 - DNA, 21 bp, Artificial Sequence
  Description of Artificial Sequence: Synthetic oligonucleotide
agaggataccctttgtatgtt

SEQ ID NO: 4203 - DNA, 21 bp, Artificial Sequence
  Description of Artificial Sequence: Synthetic oligonucleotide
agaggataccctttgtatgtt

SEQ ID NO: 4204 - DNA, 17 bp, Artificial Sequence
  Description of Artificial Sequence: Synthetic oligonucleotide
tctcgctggggcctcca

SEQ ID NO: 4205 - DNA, 22 bp, Artificial Sequence
  Description of Artificial Sequence: Synthetic oligonucleotide
gaatgttgctcggtgaacccct

SEQ ID NO: 4206 - DNA, 23 bp, Artificial Sequence
  Description of Artificial Sequence: Synthetic oligonucleotide
gtcacatccctcccaagaccctc

SEQ ID NO: 4207 - DNA, 21 bp, Artificial Sequence
  Description of Artificial Sequence: Synthetic oligonucleotide
aagcattctttcattggttgg

SEQ ID NO: 4208 - DNA, 21 bp, Artificial Sequence
  Description of Artificial Sequence: Synthetic oligonucleotide
ctagggaagaacagtgagcaa

SEQ ID NO: 4209 - DNA, 22 bp, Artificial Sequence
  Description of Artificial Sequence: Synthetic oligonucleotide
agagttgcatattagcaacagt

SEQ ID NO: 4210 - DNA, 22 bp, Artificial Sequence
  Description of Artificial Sequence: Synthetic oligonucleotide
cactggtacaagggttgggaga

SEQ ID NO: 4211 - DNA, 22 bp, Artificial Sequence
  Description of Artificial Sequence: Synthetic oligonucleotide
gatcacttttgtgactatgcaa

SEQ ID NO: 4212 - DNA, 22 bp, Artificial Sequence
  Description of Artificial Sequence: Synthetic oligonucleotide
gatcacttttgtgactatgcaa

SEQ ID NO: 4213 - DNA, 21 bp, Artificial Sequence
  Description of Artificial Sequence: Synthetic oligonucleotide
ccaagttctgtcatgcactga

SEQ ID NO: 4214 - DNA, 23 bp, Artificial Sequence
  Description of Artificial Sequence: Synthetic oligonucleotide
ttaatgctaatcgtgataggggt

SEQ ID NO: 4215 - DNA, 22 bp, Artificial Sequence
  Description of Artificial Sequence: Synthetic oligonucleotide
taggttatccgtgttgccttcg

SEQ ID NO: 4216 - DNA, 22 bp, Artificial Sequence
  Description of Artificial Sequence: Synthetic oligonucleotide
aaccagcaccccaactttggac

SEQ ID NO: 4217 - DNA, 22 bp, Artificial Sequence
  Description of Artificial Sequence: Synthetic oligonucleotide
agaggttgcccttggtgaattc

SEQ ID NO: 4218 - DNA, 20 bp, Artificial Sequence
  Description of Artificial Sequence: Synthetic oligonucleotide
tcacacctgcctcgcccccc

SEQ ID NO: 4219 - DNA, 23 bp, Artificial Sequence
  Description of Artificial Sequence: Synthetic oligonucleotide
gaacaggtagtctgaacactggg

SEQ ID NO: 4220 - DNA, 23 bp, Artificial Sequence
  Description of Artificial Sequence: Synthetic oligonucleotide
gaacaggtagtctgaacactggg

SEQ ID NO: 4221 - DNA, 23 bp, Artificial Sequence
  Description of Artificial Sequence: Synthetic oligonucleotide
catgctcagacaaccatggtgca

SEQ ID NO: 4222 - DNA, 21 bp, Artificial Sequence
  Description of Artificial Sequence: Synthetic oligonucleotide
cctcaaggagcttcagtctag

SEQ ID NO: 4223 - DNA, 22 bp, Artificial Sequence
  Description of Artificial Sequence: Synthetic oligonucleotide
aatcatacacggttgacctatt

SEQ ID NO: 4224 - DNA, 22 bp, Artificial Sequence
  Description of Artificial Sequence: Synthetic oligonucleotide
ctcccttctttcctcccgtctt

SEQ ID NO: 4225 - DNA, 21 bp, Artificial Sequence
  Description of Artificial Sequence: Synthetic oligonucleotide
gtgcattgtagttgcattgca

SEQ ID NO: 4226 - DNA, 20 bp, Artificial Sequence
  Description of Artificial Sequence: Synthetic oligonucleotide
gcaatgcaacagcaatgcac

SEQ ID NO: 4227 - DNA, 22 bp, Artificial Sequence
  Description of Artificial Sequence: Synthetic oligonucleotide
cacatctcactgtagcctcaaa

SEQ ID NO: 4228 - DNA, 22 bp, Artificial Sequence
  Description of Artificial Sequence: Synthetic oligonucleotide
tcagaccgagacaagtgcaatg

SEQ ID NO: 4229 - DNA, 18 bp, Artificial Sequence
  Description of Artificial Sequence: Synthetic oligonucleotide
acgttggctctggtggtg

SEQ ID NO: 4230 - DNA, 22 bp, Artificial Sequence
  Description of Artificial Sequence: Synthetic oligonucleotide
cacgaccgacgccacgccgagt

SEQ ID NO: 4231 - DNA, 18 bp, Artificial Sequence
  Description of Artificial Sequence: Synthetic oligonucleotide
cagcagcctccttctcaa

SEQ ID NO: 4232 - DNA, 22 bp, Artificial Sequence
  Description of Artificial Sequence: Synthetic oligonucleotide
tagcttatcagactgatgttga

SEQ ID NO: 4233 - DNA, 22 bp, Artificial Sequence
  Description of Artificial Sequence: Synthetic oligonucleotide
acagttcttcaactggcagctt

SEQ ID NO: 4234 - DNA, 21 bp, Artificial Sequence
  Description of Artificial Sequence: Synthetic oligonucleotide
aagcctgcccggctcctcggg

SEQ ID NO: 4235 - DNA, 20 bp, Artificial Sequence
  Description of Artificial Sequence: Synthetic oligonucleotide
gtttgataaactgacacaac

SEQ ID NO: 4236 - DNA, 22 bp, Artificial Sequence
  Description of Artificial Sequence: Synthetic oligonucleotide
tgacgatgacaacgatgacgta

SEQ ID NO: 4237 - DNA, 21 bp, Artificial Sequence
  Description of Artificial Sequence: Synthetic oligonucleotide
tcccagcacacatttagctca

SEQ ID NO: 4238 - DNA, 21 bp, Artificial Sequence
  Description of Artificial Sequence: Synthetic oligonucleotide
tgagctaaatgtgtgctggga

SEQ ID NO: 4239 - DNA, 23 bp, Artificial Sequence
  Description of Artificial Sequence: Synthetic oligonucleotide
gtcagaccccgaggggtcctcgc

SEQ ID NO: 4240 - DNA, 22 bp, Artificial Sequence
  Description of Artificial Sequence: Synthetic oligonucleotide
ctgctcaaaccctccaatgact

SEQ ID NO: 4241 - DNA, 22 bp, Artificial Sequence
  Description of Artificial Sequence: Synthetic oligonucleotide
gccaccttcaaatgggaagtct

SEQ ID NO: 4242 - DNA, 23 bp, Artificial Sequence
  Description of Artificial Sequence: Synthetic oligonucleotide
gaacgcctgttcttgccaggtgg

SEQ ID NO: 4243 - DNA, 22 bp, Artificial Sequence
  Description of Artificial Sequence: Synthetic oligonucleotide
atcgtgcatccttttagagtgt

SEQ ID NO: 4244 - DNA, 22 bp, Artificial Sequence
  Description of Artificial Sequence: Synthetic oligonucleotide
tcgtgcatccctttagagtgtt

SEQ ID NO: 4245 - DNA, 22 bp, Artificial Sequence
  Description of Artificial Sequence: Synthetic oligonucleotide
atcgtgcatccctttagagtgt

SEQ ID NO: 4246 - DNA, 22 bp, Artificial Sequence
  Description of Artificial Sequence: Synthetic oligonucleotide
aaacaaacatggtgcacttctt

SEQ ID NO: 4247 - DNA, 21 bp, Artificial Sequence
  Description of Artificial Sequence: Synthetic oligonucleotide
tccggttctcagggctccacc

SEQ ID NO: 4248 - DNA, 22 bp, Artificial Sequence
  Description of Artificial Sequence: Synthetic oligonucleotide
cgccacggctccaatccctata

SEQ ID NO: 4249 - DNA, 23 bp, Artificial Sequence
  Description of Artificial Sequence: Synthetic oligonucleotide
ccttctcagaaaggtgaaattta

SEQ ID NO: 4250 - DNA, 23 bp, Artificial Sequence
  Description of Artificial Sequence: Synthetic oligonucleotide
ccttctcagaaaggtgaaattta

SEQ ID NO: 4251 - DNA, 21 bp, Artificial Sequence
  Description of Artificial Sequence: Synthetic oligonucleotide
ctccagagggatgcactttct

SEQ ID NO: 4252 - DNA, 22 bp, Artificial Sequence
  Description of Artificial Sequence: Synthetic oligonucleotide
tttgtgacctggtccactaacc

SEQ ID NO: 4253 - DNA, 22 bp, Artificial Sequence
  Description of Artificial Sequence: Synthetic oligonucleotide
gcccgggtcctgtgttgtagcc

SEQ ID NO: 4254 - DNA, 20 bp, Artificial Sequence
  Description of Artificial Sequence: Synthetic oligonucleotide
ctacaaagggaagccctttc

SEQ ID NO: 4255 - DNA, 22 bp, Artificial Sequence
  Description of Artificial Sequence: Synthetic oligonucleotide
ctctagagggaagcgctttctg

SEQ ID NO: 4256 - DNA, 21 bp, Artificial Sequence
  Description of Artificial Sequence: Synthetic oligonucleotide
tacagtactgtgataactgaa

SEQ ID NO: 4257 - DNA, 21 bp, Artificial Sequence
  Description of Artificial Sequence: Synthetic oligonucleotide
ttcagttatcacagtactgta

SEQ ID NO: 4258 - DNA, 22 bp, Artificial Sequence
  Description of Artificial Sequence: Synthetic oligonucleotide
tatgtgggatggtaaaccgctt

SEQ ID NO: 4259 - DNA, 23 bp, Artificial Sequence
  Description of Artificial Sequence: Synthetic oligonucleotide
tgatagccctgtacaatgctgct

SEQ ID NO: 4260 - DNA, 22 bp, Artificial Sequence
  Description of Artificial Sequence: Synthetic oligonucleotide
tagtactgtgcatatcatctat

SEQ ID NO: 4261 - DNA, 17 bp, Artificial Sequence
  Description of Artificial Sequence: Synthetic oligonucleotide
agaaagaagcaatatga

SEQ ID NO: 4262 - DNA, 22 bp, Artificial Sequence
  Description of Artificial Sequence: Synthetic oligonucleotide
agagttgagtctggacgtcccg

SEQ ID NO: 4263 - DNA, 22 bp, Artificial Sequence
  Description of Artificial Sequence: Synthetic oligonucleotide
tggtgggcacagaatctggact

SEQ ID NO: 4264 - DNA, 23 bp, Artificial Sequence
  Description of Artificial Sequence: Synthetic oligonucleotide
acacagctcttccatatctccag

SEQ ID NO: 4265 - DNA, 22 bp, Artificial Sequence
  Description of Artificial Sequence: Synthetic oligonucleotide
cttggcacctagcaagcactca

SEQ ID NO: 4266 - DNA, 26 bp, Artificial Sequence
  Description of Artificial Sequence: Synthetic oligonucleotide
tttcagaatttgctgccatcatcatc

SEQ ID NO: 4267 - DNA, 25 bp, Artificial Sequence
  Description of Artificial Sequence: Synthetic oligonucleotide
aagaaagagtcttgctttgtcgccc

SEQ ID NO: 4268 - DNA, 17 bp, Artificial Sequence
  Description of Artificial Sequence: Synthetic oligonucleotide
gacagcctctcccccac

SEQ ID NO: 4269 - DNA, 20 bp, Artificial Sequence
  Description of Artificial Sequence: Synthetic oligonucleotide
tgtctccacagggctcttta

SEQ ID NO: 4270 - DNA, 22 bp, Artificial Sequence
  Description of Artificial Sequence: Synthetic oligonucleotide
tacgtagatatatatgtatttt

SEQ ID NO: 4271 - DNA, 21 bp, Artificial Sequence
  Description of Artificial Sequence: Synthetic oligonucleotide
ttgagagtgccattatctggg

SEQ ID NO: 4272 - DNA, 22 bp, Artificial Sequence
  Description of Artificial Sequence: Synthetic oligonucleotide
acagatgtccagccacaattct

SEQ ID NO: 4273 - DNA, 21 bp, Artificial Sequence
  Description of Artificial Sequence: Synthetic oligonucleotide
agtagtgctttctactttatg

SEQ ID NO: 4274 - DNA, 22 bp, Artificial Sequence
  Description of Artificial Sequence: Synthetic oligonucleotide
tccgagcctgggtctccctctt

SEQ ID NO: 4275 - DNA, 22 bp, Artificial Sequence
  Description of Artificial Sequence: Synthetic oligonucleotide
cagtgcaatgatgaaagggcat

SEQ ID NO: 4276 - DNA, 21 bp, Artificial Sequence
  Description of Artificial Sequence: Synthetic oligonucleotide
tctactcagaagggtgcctta

SEQ ID NO: 4277 - DNA, 21 bp, Artificial Sequence
  Description of Artificial Sequence: Synthetic oligonucleotide
ttcactccaaaaggtgcaaaa

SEQ ID NO: 4278 - DNA, 22 bp, Artificial Sequence
  Description of Artificial Sequence: Synthetic oligonucleotide
gatagagtgcagaccagggtct

SEQ ID NO: 4279 - DNA, 22 bp, Artificial Sequence
  Description of Artificial Sequence: Synthetic oligonucleotide
agaggcagggtagtgtaatgga

SEQ ID NO: 4280 - DNA, 22 bp, Artificial Sequence
  Description of Artificial Sequence: Synthetic oligonucleotide
aaattattgtacatcggatgag

SEQ ID NO: 4281 - DNA, 23 bp, Artificial Sequence
  Description of Artificial Sequence: Synthetic oligonucleotide
taatccttgctacctgggtgaga

SEQ ID NO: 4282 - DNA, 22 bp, Artificial Sequence
  Description of Artificial Sequence: Synthetic oligonucleotide
ctatacgacctgctgcctttct

SEQ ID NO: 4283 - DNA, 22 bp, Artificial Sequence
  Description of Artificial Sequence: Synthetic oligonucleotide
tcatctaataaacatttactga

SEQ ID NO: 4284 - DNA, 22 bp, Artificial Sequence
  Description of Artificial Sequence: Synthetic oligonucleotide
tcttctctgttttggccatgtg

SEQ ID NO: 4285 - DNA, 22 bp, Artificial Sequence
  Description of Artificial Sequence: Synthetic oligonucleotide
catcttaccggacagtgctgga

SEQ ID NO: 4286 - DNA, 22 bp, Artificial Sequence
  Description of Artificial Sequence: Synthetic oligonucleotide
ttcacattgtgctactgtctgc

SEQ ID NO: 4287 - DNA, 23 bp, Artificial Sequence
  Description of Artificial Sequence: Synthetic oligonucleotide
agccctgttctacagccctgagg

SEQ ID NO: 4288 - DNA, 22 bp, Artificial Sequence
  Description of Artificial Sequence: Synthetic oligonucleotide
caaaactggcaattacttttgc

SEQ ID NO: 4289 - DNA, 22 bp, Artificial Sequence
  Description of Artificial Sequence: Synthetic oligonucleotide
caaaactggcaattacttttgc

SEQ ID NO: 4290 - DNA, 22 bp, Artificial Sequence
  Description of Artificial Sequence: Synthetic oligonucleotide
gcaaaagtaattgccagttttg

SEQ ID NO: 4291 - DNA, 23 bp, Artificial Sequence
  Description of Artificial Sequence: Synthetic oligonucleotide
gtttgcacgggtgggccttgtct

SEQ ID NO: 4292 - DNA, 20 bp, Artificial Sequence
  Description of Artificial Sequence: Synthetic oligonucleotide
cttcctcgtctgtctgcccc

SEQ ID NO: 4293 - DNA, 20 bp, Artificial Sequence
  Description of Artificial Sequence: Synthetic oligonucleotide
ggggagctgtggaagcagta

SEQ ID NO: 4294 - DNA, 25 bp, Artificial Sequence
  Description of Artificial Sequence: Synthetic oligonucleotide
gaatcctggttctgtccctcactag

SEQ ID NO: 4295 - DNA, 23 bp, Artificial Sequence
  Description of Artificial Sequence: Synthetic oligonucleotide
gacgtagtcctattctctgctgc

SEQ ID NO: 4296 - DNA, 21 bp, Artificial Sequence
  Description of Artificial Sequence: Synthetic oligonucleotide
agtttcttttcctccgctgac

SEQ ID NO: 4297 - DNA, 20 bp, Artificial Sequence
  Description of Artificial Sequence: Synthetic oligonucleotide
gcaagacatcacaagactct

SEQ ID NO: 4298 - DNA, 22 bp, Artificial Sequence
  Description of Artificial Sequence: Synthetic oligonucleotide
cggggttttgagggcgagatga

SEQ ID NO: 4299 - DNA, 21 bp, Artificial Sequence
  Description of Artificial Sequence: Synthetic oligonucleotide
actggacttggagtcagaagg

SEQ ID NO: 4300 - DNA, 20 bp, Artificial Sequence
  Description of Artificial Sequence: Synthetic oligonucleotide
aaaagctgggttgagagggt

SEQ ID NO: 4301 - DNA, 20 bp, Artificial Sequence
  Description of Artificial Sequence: Synthetic oligonucleotide
aaaagctgggttgagagggt

SEQ ID NO: 4302 - DNA, 22 bp, Artificial Sequence
  Description of Artificial Sequence: Synthetic oligonucleotide
ttgccctctcaacccagctttt

SEQ ID NO: 4303 - DNA, 22 bp, Artificial Sequence
  Description of Artificial Sequence: Synthetic oligonucleotide
aaaagctgggttgagagggcaa

SEQ ID NO: 4304 - DNA, 22 bp, Artificial Sequence
  Description of Artificial Sequence: Synthetic oligonucleotide
tcgccctctcaacccagctttt

SEQ ID NO: 4305 - DNA, 20 bp, Artificial Sequence
  Description of Artificial Sequence: Synthetic oligonucleotide
ccagcagcacctggggcagt

SEQ ID NO: 4306 - DNA, 22 bp, Artificial Sequence
  Description of Artificial Sequence: Synthetic oligonucleotide
gcctgctggggtggaacctggt

SEQ ID NO: 4307 - DNA, 22 bp, Artificial Sequence
  Description of Artificial Sequence: Synthetic oligonucleotide
caggtcgtcttgcagggcttct

SEQ ID NO: 4308 - DNA, 23 bp, Artificial Sequence
  Description of Artificial Sequence: Synthetic oligonucleotide
aaagtgctgcgacatttgagcgt

SEQ ID NO: 4309 - DNA, 22 bp, Artificial Sequence
  Description of Artificial Sequence: Synthetic oligonucleotide
tcacgcgagccgaacgaacaaa

SEQ ID NO: 4310 - DNA, 22 bp, Artificial Sequence
  Description of Artificial Sequence: Synthetic oligonucleotide
gccttctgaccctaagtccagt

SEQ ID NO: 4311 - DNA, 22 bp, Artificial Sequence
  Description of Artificial Sequence: Synthetic oligonucleotide
atcacacaaaggcaacttttgt

SEQ ID NO: 4312 - DNA, 22 bp, Artificial Sequence
  Description of Artificial Sequence: Synthetic oligonucleotide
aacacacctattcaaggattca

SEQ ID NO: 4313 - DNA, 23 bp, Artificial Sequence
  Description of Artificial Sequence: Synthetic oligonucleotide
aatcgcggtttataccaaatgaa

SEQ ID NO: 4314 - DNA, 21 bp, Artificial Sequence
  Description of Artificial Sequence: Synthetic oligonucleotide
cttcttgtgctctaggattgt

SEQ ID NO: 4315 - DNA, 22 bp, Artificial Sequence
  Description of Artificial Sequence: Synthetic oligonucleotide
ctgtgtttcagctcagtaggca

SEQ ID NO: 4316 - DNA, 24 bp, Artificial Sequence
  Description of Artificial Sequence: Synthetic oligonucleotide
ctgatcagttacacatcacttcag

SEQ ID NO: 4317 - DNA, 20 bp, Artificial Sequence
  Description of Artificial Sequence: Synthetic oligonucleotide
gtccgctcggcggtggccca

SEQ ID NO: 4318 - DNA, 21 bp, Artificial Sequence
  Description of Artificial Sequence: Synthetic oligonucleotide
tgagttggccatctgagtgag

SEQ ID NO: 4319 - DNA, 22 bp, Artificial Sequence
  Description of Artificial Sequence: Synthetic oligonucleotide
cgaaaacagcaattacctttgc

SEQ ID NO: 4320 - DNA, 21 bp, Artificial Sequence
  Description of Artificial Sequence: Synthetic oligonucleotide
tagataaaatattggtacctg

SEQ ID NO: 4321 - DNA, 22 bp, Artificial Sequence
  Description of Artificial Sequence: Synthetic oligonucleotide
aaagtgcttccttttagagggt

SEQ ID NO: 4322 - DNA, 22 bp, Artificial Sequence
  Description of Artificial Sequence: Synthetic oligonucleotide
catgattgccacgtctgcagta

SEQ ID NO: 4323 - DNA, 22 bp, Artificial Sequence
  Description of Artificial Sequence: Synthetic oligonucleotide
aaatcccatccccaggaacccc

SEQ ID NO: 4324 - DNA, 22 bp, Artificial Sequence
  Description of Artificial Sequence: Synthetic oligonucleotide
ctctagagggaagcactttctc

SEQ ID NO: 4325 - DNA, 22 bp, Artificial Sequence
  Description of Artificial Sequence: Synthetic oligonucleotide
ggagcagcacagccaatattgg

SEQ ID NO: 4326 - DNA, 22 bp, Artificial Sequence
  Description of Artificial Sequence: Synthetic oligonucleotide
attctaatttctccacgtcttt

SEQ ID NO: 4327 - DNA, 19 bp, Artificial Sequence
  Description of Artificial Sequence: Synthetic oligonucleotide
gctcctgtccaactggctc

SEQ ID NO: 4328 - DNA, 21 bp, Artificial Sequence
  Description of Artificial Sequence: Synthetic oligonucleotide
caacaccagtcgatgggctgt

SEQ ID NO: 4329 - DNA, 22 bp, Artificial Sequence
  Description of Artificial Sequence: Synthetic oligonucleotide
agagcttagctgattggtgaac

SEQ ID NO: 4330 - DNA, 23 bp, Artificial Sequence
  Description of Artificial Sequence: Synthetic oligonucleotide
tccaatcagttcctgatgcagta

SEQ ID NO: 4331 - DNA, 22 bp, Artificial Sequence
  Description of Artificial Sequence: Synthetic oligonucleotide
actgcctgtctgtgcctgctgt

SEQ ID NO: 4332 - DNA, 21 bp, Artificial Sequence
  Description of Artificial Sequence: Synthetic oligonucleotide
gtctgtcaattcataggtcat

SEQ ID NO: 4333 - DNA, 21 bp, Artificial Sequence
  Description of Artificial Sequence: Synthetic oligonucleotide
ggccgtgactggagactgtta

SEQ ID NO: 4334 - DNA, 22 bp, Artificial Sequence
  Description of Artificial Sequence: Synthetic oligonucleotide
tcagccgctgtcacacgcacag

SEQ ID NO: 4335 - DNA, 22 bp, Artificial Sequence
  Description of Artificial Sequence: Synthetic oligonucleotide
aggcgaaggatgacaaagggaa

SEQ ID NO: 4336 - DNA, 22 bp, Artificial Sequence
  Description of Artificial Sequence: Synthetic oligonucleotide
acaggccgggacaagtgcaata

SEQ ID NO: 4337 - DNA, 22 bp, Artificial Sequence
  Description of Artificial Sequence: Synthetic oligonucleotide
tattgcacttgtcccggcctgt

SEQ ID NO: 4338 - DNA, 22 bp, Artificial Sequence
  Description of Artificial Sequence: Synthetic oligonucleotide
tattgcactcgtcccggcctcc

SEQ ID NO: 4339 - DNA, 21 bp, Artificial Sequence
  Description of Artificial Sequence: Synthetic oligonucleotide
ttgtgcttgatctaaccatgt

SEQ ID NO: 4340 - DNA, 21 bp, Artificial Sequence
  Description of Artificial Sequence: Synthetic oligonucleotide
acatggttagatcaagcacaa

SEQ ID NO: 4341 - DNA, 22 bp, Artificial Sequence
  Description of Artificial Sequence: Synthetic oligonucleotide
gagtgccttcttttggagcgtt

SEQ ID NO: 4342 - DNA, 22 bp, Artificial Sequence
  Description of Artificial Sequence: Synthetic oligonucleotide
gagtgccttcttttggagcgtt

SEQ ID NO: 4343 - DNA, 22 bp, Artificial Sequence
  Description of Artificial Sequence: Synthetic oligonucleotide
atacatacttctttacattcca

SEQ ID NO: 4344 - DNA, 22 bp, Artificial Sequence
  Description of Artificial Sequence: Synthetic oligonucleotide
tggaatgtaaagaagtatgtat

SEQ ID NO: 4345 - DNA, 22 bp, Artificial Sequence
  Description of Artificial Sequence: Synthetic oligonucleotide
gggcggacacgacattcccgat

SEQ ID NO: 4346 - DNA, 22 bp, Artificial Sequence
  Description of Artificial Sequence: Synthetic oligonucleotide
aaaatggttccctttagagtgt

SEQ ID NO: 4347 - DNA, 23 bp, Artificial Sequence
  Description of Artificial Sequence: Synthetic oligonucleotide
acaacaaaatcactagtcttcca

SEQ ID NO: 4348 - DNA, 23 bp, Artificial Sequence
  Description of Artificial Sequence: Synthetic oligonucleotide
tggaagactagtgattttgttgt

SEQ ID NO: 4349 - DNA, 23 bp, Artificial Sequence
  Description of Artificial Sequence: Synthetic oligonucleotide
tggaagactagtgattttgttgt

SEQ ID NO: 4350 - DNA, 23 bp, Artificial Sequence
  Description of Artificial Sequence: Synthetic oligonucleotide
tctttggttatctagctgtatga

SEQ ID NO: 4351 - DNA, 23 bp, Artificial Sequence
  Description of Artificial Sequence: Synthetic oligonucleotide
tcatacagctagataaccaaaga

SEQ ID NO: 4352 - DNA, 23 bp, Artificial Sequence
  Description of Artificial Sequence: Synthetic oligonucleotide
tcatacagctagataaccaaaga

SEQ ID NO: 4353 - DNA, 22 bp, Artificial Sequence
  Description of Artificial Sequence: Synthetic oligonucleotide
gggggtccccggtgctcggatc

SEQ ID NO: 4354 - DNA, 22 bp, Artificial Sequence
  Description of Artificial Sequence: Synthetic oligonucleotide
aagtgctgtcatagctgaggtc

SEQ ID NO: 4355 - DNA, 22 bp, Artificial Sequence
  Description of Artificial Sequence: Synthetic oligonucleotide
aagtgctgtcatagctgaggtc

SEQ ID NO: 4356 - DNA, 22 bp, Artificial Sequence
  Description of Artificial Sequence: Synthetic oligonucleotide
caaagaagtatatgcataggaa

SEQ ID NO: 4357 - DNA, 22 bp, Artificial Sequence
  Description of Artificial Sequence: Synthetic oligonucleotide
ttcacccaaagaggtgtcagtc

SEQ ID NO: 4358 - DNA, 22 bp, Artificial Sequence
  Description of Artificial Sequence: Synthetic oligonucleotide
ggtgcagtgctgcatctctggt

SEQ ID NO: 4359 - DNA, 23 bp, Artificial Sequence
  Description of Artificial Sequence: Synthetic oligonucleotide
ctcttgagggaagcactttctgt

SEQ ID NO: 4360 - DNA, 21 bp, Artificial Sequence
  Description of Artificial Sequence: Synthetic oligonucleotide
aatattatacagtcaacctct

SEQ ID NO: 4361 - DNA, 23 bp, Artificial Sequence
  Description of Artificial Sequence: Synthetic oligonucleotide
cctagagagggtgagaacctgcc

SEQ ID NO: 4362 - DNA, 22 bp, Artificial Sequence
  Description of Artificial Sequence: Synthetic oligonucleotide
ataatacatggttaacctcttt

SEQ ID NO: 4363 - DNA, 21 bp, Artificial Sequence
  Description of Artificial Sequence: Synthetic oligonucleotide
aatggcgccactagggttgtg

SEQ ID NO: 4364 - DNA, 21 bp, Artificial Sequence
  Description of Artificial Sequence: Synthetic oligonucleotide
cagtagagattgtttcaacac

SEQ ID NO: 4365 - DNA, 22 bp, Artificial Sequence
  Description of Artificial Sequence: Synthetic oligonucleotide
gaaagcgcttccctttgctgga

SEQ ID NO: 4366 - DNA, 22 bp, Artificial Sequence
  Description of Artificial Sequence: Synthetic oligonucleotide
gaaagcgcttccctttgctgga

SEQ ID NO: 4367 - DNA, 22 bp, Artificial Sequence
  Description of Artificial Sequence: Synthetic oligonucleotide
tttaggataagcttgacttttg

SEQ ID NO: 4368 - DNA, 17 bp, Artificial Sequence
  Description of Artificial Sequence: Synthetic oligonucleotide
taattgcttccatgttt

SEQ ID NO: 4369 - DNA, 23 bp, Artificial Sequence
  Description of Artificial Sequence: Synthetic oligonucleotide
ggaagccatcaagtcgctgcagg

SEQ ID NO: 4370 - DNA, 23 bp, Artificial Sequence
  Description of Artificial Sequence: Synthetic oligonucleotide
cctgcagcgacttgatggcttcc

SEQ ID NO: 4371 - DNA, 23 bp, Artificial Sequence
  Description of Artificial Sequence: Synthetic oligonucleotide
ggaagccatcaagtcgctgcagg

SEQ ID NO: 4372 - DNA, 23 bp, Artificial Sequence
  Description of Artificial Sequence: Synthetic oligonucleotide
acactcaaacatggaagcactta

SEQ ID NO: 4373 - DNA, 23 bp, Artificial Sequence
  Description of Artificial Sequence: Synthetic oligonucleotide
ccactgaaacatggaagcactta

SEQ ID NO: 4374 - DNA, 23 bp, Artificial Sequence
  Description of Artificial Sequence: Synthetic oligonucleotide
ctactaaaacatggaagcactta

SEQ ID NO: 4375 - DNA, 22 bp, Artificial Sequence
  Description of Artificial Sequence: Synthetic oligonucleotide
acacacccacgcgagccggaaa

SEQ ID NO: 4376 - DNA, 21 bp, Artificial Sequence
  Description of Artificial Sequence: Synthetic oligonucleotide
cggctcgggtggcggcgacgg

SEQ ID NO: 4377 - DNA, 22 bp, Artificial Sequence
  Description of Artificial Sequence: Synthetic oligonucleotide
gctgggcttacgttgggagaac

SEQ ID NO: 4378 - DNA, 17 bp, Artificial Sequence
  Description of Artificial Sequence: Synthetic oligonucleotide
taagtgcttccatgctt

SEQ ID NO: 4379 - DNA, 23 bp, Artificial Sequence
  Description of Artificial Sequence: Synthetic oligonucleotide
tcatagccctgtacaatgctgct

SEQ ID NO: 4380 - DNA, 23 bp, Artificial Sequence
  Description of Artificial Sequence: Synthetic oligonucleotide
agcagcattgtacagggctatga

SEQ ID NO: 4381 - DNA, 22 bp, Artificial Sequence
  Description of Artificial Sequence: Synthetic oligonucleotide
cacaagttcggatctacgggtt

SEQ ID NO: 4382 - DNA, 22 bp, Artificial Sequence
  Description of Artificial Sequence: Synthetic oligonucleotide
gctatttcacgacaccagggtt

SEQ ID NO: 4383 - DNA, 22 bp, Artificial Sequence
  Description of Artificial Sequence: Synthetic oligonucleotide
aacgccattatcacactaaata

SEQ ID NO: 4384 - DNA, 23 bp, Artificial Sequence
  Description of Artificial Sequence: Synthetic oligonucleotide
accacaggagtctgagcatttga

SEQ ID NO: 4385 - DNA, 23 bp, Artificial Sequence
  Description of Artificial Sequence: Synthetic oligonucleotide
accacaggagtctgagcatttga

SEQ ID NO: 4386 - DNA, 22 bp, Artificial Sequence
  Description of Artificial Sequence: Synthetic oligonucleotide
cgtgtatttgacaagctgagtt

SEQ ID NO: 4387 - DNA, 22 bp, Artificial Sequence
  Description of Artificial Sequence: Synthetic oligonucleotide
aaattgcatcgtgatccacccg

SEQ ID NO: 4388 - DNA, 22 bp, Artificial Sequence
  Description of Artificial Sequence: Synthetic oligonucleotide
aaggagctcacagtctattgag

SEQ ID NO: 4389 - DNA, 22 bp, Artificial Sequence
  Description of Artificial Sequence: Synthetic oligonucleotide
ctgtcccccaggcctgtaccag

SEQ ID NO: 4390 - DNA, 22 bp, Artificial Sequence
  Description of Artificial Sequence: Synthetic oligonucleotide
caagctcgcttctatgggtctg

SEQ ID NO: 4391 - DNA, 18 bp, Artificial Sequence
  Description of Artificial Sequence: Synthetic oligonucleotide
tccagtgccctcctctcc

SEQ ID NO: 4392 - DNA, 22 bp, Artificial Sequence
  Description of Artificial Sequence: Synthetic oligonucleotide
aagcccttaccccaaaaagtat

SEQ ID NO: 4393 - DNA, 22 bp, Artificial Sequence
  Description of Artificial Sequence: Synthetic oligonucleotide
atattaccattagctcatcttt

SEQ ID NO: 4394 - DNA, 23 bp, Artificial Sequence
  Description of Artificial Sequence: Synthetic oligonucleotide
taccctgtagaaccgaatttgtg

SEQ ID NO: 4395 - DNA, 18 bp, Artificial Sequence
  Description of Artificial Sequence: Synthetic oligonucleotide
tgaggcagtagattgaat

SEQ ID NO: 4396 - DNA, 23 bp, Artificial Sequence
  Description of Artificial Sequence: Synthetic oligonucleotide
cacaaattcggatctacagggta

SEQ ID NO: 4397 - DNA, 23 bp, Artificial Sequence
  Description of Artificial Sequence: Synthetic oligonucleotide
atcccttgcaggggctgttgggt

SEQ ID NO: 4398 - DNA, 21 bp, Artificial Sequence
  Description of Artificial Sequence: Synthetic oligonucleotide
acagtctgctgaggttggagc

SEQ ID NO: 4399 - DNA, 21 bp, Artificial Sequence
  Description of Artificial Sequence: Synthetic oligonucleotide
ggctagcaacagcgcttacct

SEQ ID NO: 4400 - DNA, 20 bp, Artificial Sequence
  Description of Artificial Sequence: Synthetic oligonucleotide
atttctatatctatctccat

SEQ ID NO: 4401 - DNA, 22 bp, Artificial Sequence
  Description of Artificial Sequence: Synthetic oligonucleotide
ctgaagctcagagggctctgat

SEQ ID NO: 4402 - DNA, 19 bp, Artificial Sequence
  Description of Artificial Sequence: Synthetic oligonucleotide
agctgtctgaaaatgtctt

SEQ ID NO: 4403 - DNA, 21 bp, Artificial Sequence
  Description of Artificial Sequence: Synthetic oligonucleotide
ggactatagaactttccccct

SEQ ID NO: 4404 - DNA, 21 bp, Artificial Sequence
  Description of Artificial Sequence: Synthetic oligonucleotide
agggggaaagttctatagtcc

SEQ ID NO: 4405 - DNA, 21 bp, Artificial Sequence
  Description of Artificial Sequence: Synthetic oligonucleotide
tagttggcaagtctagaacca

SEQ ID NO: 4406 - DNA, 25 bp, Artificial Sequence
  Description of Artificial Sequence: Synthetic oligonucleotide
tgggaacgggttccggcagacgctg

SEQ ID NO: 4407 - DNA, 23 bp, Artificial Sequence
  Description of Artificial Sequence: Synthetic oligonucleotide
tctcacacagaaatcgcacccgt

SEQ ID NO: 4408 - DNA, 19 bp, Artificial Sequence
  Description of Artificial Sequence: Synthetic oligonucleotide
tccctgatccaaaaatcca

SEQ ID NO: 4409 - DNA, 24 bp, Artificial Sequence
  Description of Artificial Sequence: Synthetic oligonucleotide
actgctggtcttcagtcagggcca

SEQ ID NO: 4410 - DNA, 22 bp, Artificial Sequence
  Description of Artificial Sequence: Synthetic oligonucleotide
ggagatggagccagggccctaa

SEQ ID NO: 4411 - DNA, 17 bp, Artificial Sequence
  Description of Artificial Sequence: Synthetic oligonucleotide
cacctgaattacttgaa

SEQ ID NO: 4412 - DNA, 22 bp, Artificial Sequence
  Description of Artificial Sequence: Synthetic oligonucleotide
tgtgaggttggcattgttgtct

SEQ ID NO: 4413 - DNA, 22 bp, Artificial Sequence
  Description of Artificial Sequence: Synthetic oligonucleotide
ccccccactgggccgtacccac

SEQ ID NO: 4414 - DNA, 21 bp, Artificial Sequence
  Description of Artificial Sequence: Synthetic oligonucleotide
tgattgccactgtctgcagta

SEQ ID NO: 4415 - DNA, 21 bp, Artificial Sequence
  Description of Artificial Sequence: Synthetic oligonucleotide
tgattgccactgtctgcagta

SEQ ID NO: 4416 - DNA, 21 bp, Artificial Sequence
  Description of Artificial Sequence: Synthetic oligonucleotide
ccccacctcctctctcctcag

SEQ ID NO: 4417 - DNA, 21 bp, Artificial Sequence
  Description of Artificial Sequence: Synthetic oligonucleotide
taccacagggtagaaccacgg

SEQ ID NO: 4418 - DNA, 22 bp, Artificial Sequence
  Description of Artificial Sequence: Synthetic oligonucleotide
cctcccacacccaaggcttgca

SEQ ID NO: 4419 - DNA, 22 bp, Artificial Sequence
  Description of Artificial Sequence: Synthetic oligonucleotide
ttcattcggctgtccagatgta

SEQ ID NO: 4420 - DNA, 21 bp, Artificial Sequence
  Description of Artificial Sequence: Synthetic oligonucleotide
ttcaagtaattcaggataggt

SEQ ID NO: 4421 - DNA, 22 bp, Artificial Sequence
  Description of Artificial Sequence: Synthetic oligonucleotide
ggaaagacagtagactgtatag

SEQ ID NO: 4422 - DNA, 19 bp, Artificial Sequence
  Description of Artificial Sequence: Synthetic oligonucleotide
tagcatacagatacgccca

SEQ ID NO: 4423 - DNA, 20 bp, Artificial Sequence
  Description of Artificial Sequence: Synthetic oligonucleotide
ccatggatctccaggtgggt

SEQ ID NO: 4424 - DNA, 22 bp, Artificial Sequence
  Description of Artificial Sequence: Synthetic oligonucleotide
aaagtgcatctttttagaggat

SEQ ID NO: 4425 - DNA, 18 bp, Artificial Sequence
  Description of Artificial Sequence: Synthetic oligonucleotide
atgacacctccctgtgaa

SEQ ID NO: 4426 - DNA, 18 bp, Artificial Sequence
  Description of Artificial Sequence: Synthetic oligonucleotide
atgacacctccctgtgaa

SEQ ID NO: 4427 - DNA, 20 bp, Artificial Sequence
  Description of Artificial Sequence: Synthetic oligonucleotide
acaatgagaacccatggtct

SEQ ID NO: 4428 - DNA, 22 bp, Artificial Sequence
  Description of Artificial Sequence: Synthetic oligonucleotide
ggggacgaaatccaagcgcagc

SEQ ID NO: 4429 - DNA, 22 bp, Artificial Sequence
  Description of Artificial Sequence: Synthetic oligonucleotide
ttttcaactctaatgggagaga

SEQ ID NO: 4430 - DNA, 21 bp, Artificial Sequence
  Description of Artificial Sequence: Synthetic oligonucleotide
aggtaataccaataccttgtg

SEQ ID NO: 4431 - DNA, 19 bp, Artificial Sequence
  Description of Artificial Sequence: Synthetic oligonucleotide
tgtctctgctggggtttct

SEQ ID NO: 4432 - DNA, 23 bp, Artificial Sequence
  Description of Artificial Sequence: Synthetic oligonucleotide
tcaccaaaacatggaagcactta

SEQ ID NO: 4433 - DNA, 22 bp, Artificial Sequence
  Description of Artificial Sequence: Synthetic oligonucleotide
acatcatcgcatattgacacaa

SEQ ID NO: 4434 - DNA, 22 bp, Artificial Sequence
  Description of Artificial Sequence: Synthetic oligonucleotide
gcacaaatctccagaccaccca

SEQ ID NO: 4435 - DNA, 22 bp, Artificial Sequence
  Description of Artificial Sequence: Synthetic oligonucleotide
ctttcagtcggatgtttacagc

SEQ ID NO: 4436 - DNA, 23 bp, Artificial Sequence
  Description of Artificial Sequence: Synthetic oligonucleotide
tcttggagtaggtcattgggtgg

SEQ ID NO: 4437 - DNA, 21 bp, Artificial Sequence
  Description of Artificial Sequence: Synthetic oligonucleotide
agttctcccaacgtaaaccca

SEQ ID NO: 4438 - DNA, 22 bp, Artificial Sequence
  Description of Artificial Sequence: Synthetic oligonucleotide
catattggcactgcacatgatt

SEQ ID NO: 4439 - DNA, 24 bp, Artificial Sequence
  Description of Artificial Sequence: Synthetic oligonucleotide
gaagtcactcccaggcagctgcaa

SEQ ID NO: 4440 - DNA, 22 bp, Artificial Sequence
  Description of Artificial Sequence: Synthetic oligonucleotide
catcttactgggcagcattgga

SEQ ID NO: 4441 - DNA, 22 bp, Artificial Sequence
  Description of Artificial Sequence: Synthetic oligonucleotide
aaccatcgaccgttgagtggac

SEQ ID NO: 4442 - DNA, 23 bp, Artificial Sequence
  Description of Artificial Sequence: Synthetic oligonucleotide
tctactccaaaaggctacaatca

SEQ ID NO: 4443 - DNA, 22 bp, Artificial Sequence
  Description of Artificial Sequence: Synthetic oligonucleotide
tttagagacggggtcttgctct

SEQ ID NO: 4444 - DNA, 22 bp, Artificial Sequence
  Description of Artificial Sequence: Synthetic oligonucleotide
ggagaaattatccttggtgtgt

SEQ ID NO: 4445 - DNA, 22 bp, Artificial Sequence
  Description of Artificial Sequence: Synthetic oligonucleotide
acagattcgattctaggggaat

SEQ ID NO: 4446 - DNA, 25 bp, Artificial Sequence
  Description of Artificial Sequence: Synthetic oligonucleotide
gctgggcagggcttctgagctcctt

SEQ ID NO: 4447 - DNA, 20 bp, Artificial Sequence
  Description of Artificial Sequence: Synthetic oligonucleotide
aggaatgttccttctttgcc

SEQ ID NO: 4448 - DNA, 21 bp, Artificial Sequence
  Description of Artificial Sequence: Synthetic oligonucleotide
tcacccagatctgcggcctaa

SEQ ID NO: 4449 - DNA, 22 bp, Artificial Sequence
  Description of Artificial Sequence: Synthetic oligonucleotide
cccaacaacatgaaactaccta

SEQ ID NO: 4450 - DNA, 22 bp, Artificial Sequence
  Description of Artificial Sequence: Synthetic oligonucleotide
taggtagtttcatgttgttggg

SEQ ID NO: 4451 - DNA, 22 bp, Artificial Sequence
  Description of Artificial Sequence: Synthetic oligonucleotide
cccaacaacaggaaactaccta

SEQ ID NO: 4452 - DNA, 22 bp, Artificial Sequence
  Description of Artificial Sequence: Synthetic oligonucleotide
ggagagcctccacccaaccctc

SEQ ID NO: 4453 - DNA, 21 bp, Artificial Sequence
  Description of Artificial Sequence: Synthetic oligonucleotide
caaagcgcttccctttggagc

SEQ ID NO: 4454 - DNA, 18 bp, Artificial Sequence
  Description of Artificial Sequence: Synthetic oligonucleotide
ccactgaaccacccatgc

SEQ ID NO: 4455 - DNA, 22 bp, Artificial Sequence
  Description of Artificial Sequence: Synthetic oligonucleotide
gtaatgcaacaaatccccaccc

SEQ ID NO: 4456 - DNA, 25 bp, Artificial Sequence
  Description of Artificial Sequence: Synthetic oligonucleotide
accaacggacctacttccctccgcc

SEQ ID NO: 4457 - DNA, 22 bp, Artificial Sequence
  Description of Artificial Sequence: Synthetic oligonucleotide
gcagcaagtacccacagtgcgg

SEQ ID NO: 4458 - DNA, 22 bp, Artificial Sequence
  Description of Artificial Sequence: Synthetic oligonucleotide
aattacaatacaatctgataag

SEQ ID NO: 4459 - DNA, 21 bp, Artificial Sequence
  Description of Artificial Sequence: Synthetic oligonucleotide
agacacaccacggcacacttc

SEQ ID NO: 4460 - DNA, 22 bp, Artificial Sequence
  Description of Artificial Sequence: Synthetic oligonucleotide
ctctagagggaagcactttctg

SEQ ID NO: 4461 - DNA, 22 bp, Artificial Sequence
  Description of Artificial Sequence: Synthetic oligonucleotide
gagcttattcataaaagtgcag

SEQ ID NO: 4462 - DNA, 22 bp, Artificial Sequence
  Description of Artificial Sequence: Synthetic oligonucleotide
ttgcatatgtaggatgtcccat

SEQ ID NO: 4463 - DNA, 20 bp, Artificial Sequence
  Description of Artificial Sequence: Synthetic oligonucleotide
ctggaggaagggcccagagg

SEQ ID NO: 4464 - DNA, 23 bp, Artificial Sequence
  Description of Artificial Sequence: Synthetic oligonucleotide
acacttactggacacctactagg

SEQ ID NO: 4465 - DNA, 19 bp, Artificial Sequence
  Description of Artificial Sequence: Synthetic oligonucleotide
gtgtctgcttcctgtggga

SEQ ID NO: 4466 - DNA, 22 bp, Artificial Sequence
  Description of Artificial Sequence: Synthetic oligonucleotide
acggaagggcagagagggccag

SEQ ID NO: 4467 - DNA, 22 bp, Artificial Sequence
  Description of Artificial Sequence: Synthetic oligonucleotide
aacacacctggttaacctcttt

SEQ ID NO: 4468 - DNA, 22 bp, Artificial Sequence
  Description of Artificial Sequence: Synthetic oligonucleotide
aacacacctggttaacctcttt

SEQ ID NO: 4469 - DNA, 22 bp, Artificial Sequence
  Description of Artificial Sequence: Synthetic oligonucleotide
tggggaccctccctgaaccaag

SEQ ID NO: 4470 - DNA, 22 bp, Artificial Sequence
  Description of Artificial Sequence: Synthetic oligonucleotide
gcacagcaagtgtagacaggca

SEQ ID NO: 4471 - DNA, 21 bp, Artificial Sequence
  Description of Artificial Sequence: Synthetic oligonucleotide
aagacgggaggagaggagtga

SEQ ID NO: 4472 - DNA, 22 bp, Artificial Sequence
  Description of Artificial Sequence: Synthetic oligonucleotide
gtagattctccttctatgagta

SEQ ID NO: 4473 - DNA, 22 bp, Artificial Sequence
  Description of Artificial Sequence: Synthetic oligonucleotide
atggttccgtcaagcaccatgg

SEQ ID NO: 4474 - DNA, 22 bp, Artificial Sequence
  Description of Artificial Sequence: Synthetic oligonucleotide
gcaagtgcctccatgttaaagt

SEQ ID NO: 4475 - DNA, 22 bp, Artificial Sequence
  Description of Artificial Sequence: Synthetic oligonucleotide
gtgaacgggcgccatcccgagg

SEQ ID NO: 4476 - DNA, 22 bp, Artificial Sequence
  Description of Artificial Sequence: Synthetic oligonucleotide
tggttgaccatagaacatgcgc

SEQ ID NO: 4477 - DNA, 22 bp, Artificial Sequence
  Description of Artificial Sequence: Synthetic oligonucleotide
aaatatcacacacactaaattg

SEQ ID NO: 4478 - DNA, 21 bp, Artificial Sequence
  Description of Artificial Sequence: Synthetic oligonucleotide
ttaatatcggacaaccattgt

SEQ ID NO: 4479 - DNA, 26 bp, Artificial Sequence
  Description of Artificial Sequence: Synthetic oligonucleotide
atcactccgtactttcatcctccaac

SEQ ID NO: 4480 - DNA, 22 bp, Artificial Sequence
  Description of Artificial Sequence: Synthetic oligonucleotide
aatgcacccgggcaaggattct

SEQ ID NO: 4481 - DNA, 22 bp, Artificial Sequence
  Description of Artificial Sequence: Synthetic oligonucleotide
gtcatacacggctctcctctct

SEQ ID NO: 4482 - DNA, 22 bp, Artificial Sequence
  Description of Artificial Sequence: Synthetic oligonucleotide
gtggggtgggtggtcaggccga

SEQ ID NO: 4483 - DNA, 22 bp, Artificial Sequence
  Description of Artificial Sequence: Synthetic oligonucleotide
taaagcttgccactgaagaact

SEQ ID NO: 4484 - DNA, 24 bp, Artificial Sequence
  Description of Artificial Sequence: Synthetic oligonucleotide
tccctgagaccctttaacctgtga

SEQ ID NO: 4485 - DNA, 22 bp, Artificial Sequence
  Description of Artificial Sequence: Synthetic oligonucleotide
acttgtatgctagctcaggtag

SEQ ID NO: 4486 - DNA, 20 bp, Artificial Sequence
  Description of Artificial Sequence: Synthetic oligonucleotide
gcagaagcatttccacacac

SEQ ID NO: 4487 - DNA, 20 bp, Artificial Sequence
  Description of Artificial Sequence: Synthetic oligonucleotide
agtacatcatctatactgta

SEQ ID NO: 4488 - DNA, 23 bp, Artificial Sequence
  Description of Artificial Sequence: Synthetic oligonucleotide
gtccagttttcccaggaatccct

SEQ ID NO: 4489 - DNA, 21 bp, Artificial Sequence
  Description of Artificial Sequence: Synthetic oligonucleotide
tgagatgaagcactgtagctc

SEQ ID NO: 4490 - DNA, 22 bp, Artificial Sequence
  Description of Artificial Sequence: Synthetic oligonucleotide
tgtgtcactcgatgaccactgt

SEQ ID NO: 4491 - DNA, 22 bp, Artificial Sequence
  Description of Artificial Sequence: Synthetic oligonucleotide
taacactgtctggtaaagatgg

SEQ ID NO: 4492 - DNA, 23 bp, Artificial Sequence
  Description of Artificial Sequence: Synthetic oligonucleotide
cactcagccttgagggcactttc

SEQ ID NO: 4493 - DNA, 23 bp, Artificial Sequence
  Description of Artificial Sequence: Synthetic oligonucleotide
cactcagccttgagggcactttc

SEQ ID NO: 4494 - DNA, 22 bp, Artificial Sequence
  Description of Artificial Sequence: Synthetic oligonucleotide
aggtggtccgtggcgcgttcgc

SEQ ID NO: 4495 - DNA, 21 bp, Artificial Sequence
  Description of Artificial Sequence: Synthetic oligonucleotide
aacggaaccactagtgacttg

SEQ ID NO: 4496 - DNA, 22 bp, Artificial Sequence
  Description of Artificial Sequence: Synthetic oligonucleotide
tgtcagtttgtcaaatacccca

SEQ ID NO: 4497 - DNA, 21 bp, Artificial Sequence
  Description of Artificial Sequence: Synthetic oligonucleotide
acccagtagccagatgtagct

SEQ ID NO: 4498 - DNA, 23 bp, Artificial Sequence
  Description of Artificial Sequence: Synthetic oligonucleotide
gaaacccagcagacaatgtagct

SEQ ID NO: 4499 - DNA, 23 bp, Artificial Sequence
  Description of Artificial Sequence: Synthetic oligonucleotide
tctggctccgtgtcttcactccc

SEQ ID NO: 4500 - DNA, 22 bp, Artificial Sequence
  Description of Artificial Sequence: Synthetic oligonucleotide
aaagtgcttccctttggactgt

SEQ ID NO: 4501 - DNA, 22 bp, Artificial Sequence
  Description of Artificial Sequence: Synthetic oligonucleotide
aaaagtaattgcggtttttgcc

SEQ ID NO: 4502 - DNA, 22 bp, Artificial Sequence
  Description of Artificial Sequence: Synthetic oligonucleotide
cacttagcaggttgtattatat

SEQ ID NO: 4503 - DNA, 22 bp, Artificial Sequence
  Description of Artificial Sequence: Synthetic oligonucleotide
agcctatcctggattacttgaa

SEQ ID NO: 4504 - DNA, 22 bp, Artificial Sequence
  Description of Artificial Sequence: Synthetic oligonucleotide
ttcaagtaatccaggataggct

SEQ ID NO: 4505 - DNA, 22 bp, Artificial Sequence
  Description of Artificial Sequence: Synthetic oligonucleotide
cacttatcaggttgtattataa

SEQ ID NO: 4506 - DNA, 21 bp, Artificial Sequence
  Description of Artificial Sequence: Synthetic oligonucleotide
tttagcataagtatgtcccaa

SEQ ID NO: 4507 - DNA, 21 bp, Artificial Sequence
  Description of Artificial Sequence: Synthetic oligonucleotide
tttagcataagtatgtcccaa

SEQ ID NO: 4508 - DNA, 21 bp, Artificial Sequence
  Description of Artificial Sequence: Synthetic oligonucleotide
tttagcataagtatgtcccaa

SEQ ID NO: 4509 - DNA, 21 bp, Artificial Sequence
  Description of Artificial Sequence: Synthetic oligonucleotide
tttagcataagtatgtcccaa

SEQ ID NO: 4510 - DNA, 21 bp, Artificial Sequence
  Description of Artificial Sequence: Synthetic oligonucleotide
tttagcataagtatgtcccaa

SEQ ID NO: 4511 - DNA, 21 bp, Artificial Sequence
  Description of Artificial Sequence: Synthetic oligonucleotide
ttgggacatacttatgctaaa

SEQ ID NO: 4512 - DNA, 21 bp, Artificial Sequence
  Description of Artificial Sequence: Synthetic oligonucleotide
tttagcataagtatgtcccaa

SEQ ID NO: 4513 - DNA, 21 bp, Artificial Sequence
  Description of Artificial Sequence: Synthetic oligonucleotide
ttgggacatacttatgctaaa

SEQ ID NO: 4514 - DNA, 21 bp, Artificial Sequence
  Description of Artificial Sequence: Synthetic oligonucleotide
tttagcataagtatgtcccaa

SEQ ID NO: 4515 - DNA, 21 bp, Artificial Sequence
  Description of Artificial Sequence: Synthetic oligonucleotide
ttgggacatacttatgctaaa

SEQ ID NO: 4516 - DNA, 21 bp, Artificial Sequence
  Description of Artificial Sequence: Synthetic oligonucleotide
tttagcataagtatgtcccaa

SEQ ID NO: 4517 - DNA, 22 bp, Artificial Sequence
  Description of Artificial Sequence: Synthetic oligonucleotide
tgaacacaaggtactggtacta

SEQ ID NO: 4518 - DNA, 24 bp, Artificial Sequence
  Description of Artificial Sequence: Synthetic oligonucleotide
actgggcacaaacatgtccaggtc

SEQ ID NO: 4519 - DNA, 22 bp, Artificial Sequence
  Description of Artificial Sequence: Synthetic oligonucleotide
ggacctaaaaatacaatgcata

SEQ ID NO: 4520 - DNA, 21 bp, Artificial Sequence
  Description of Artificial Sequence: Synthetic oligonucleotide
tttccataggtgatgagtcac

SEQ ID NO: 4521 - DNA, 22 bp, Artificial Sequence
  Description of Artificial Sequence: Synthetic oligonucleotide
ctcagtcccaggcaaaccataa

SEQ ID NO: 4522 - DNA, 22 bp, Artificial Sequence
  Description of Artificial Sequence: Synthetic oligonucleotide
gcagcaaacatctgactgaaag

SEQ ID NO: 4523 - DNA, 22 bp, Artificial Sequence
  Description of Artificial Sequence: Synthetic oligonucleotide
atattaggaacacatcgcaaaa

SEQ ID NO: 4524 - DNA, 22 bp, Artificial Sequence
  Description of Artificial Sequence: Synthetic oligonucleotide
atattaggaacacatcgcaaaa

SEQ ID NO: 4525 - DNA, 21 bp, Artificial Sequence
  Description of Artificial Sequence: Synthetic oligonucleotide
caaagaggaaggtcccattac

SEQ ID NO: 4526 - DNA, 22 bp, Artificial Sequence
  Description of Artificial Sequence: Synthetic oligonucleotide
cctaatgattcatcattctcaa

SEQ ID NO: 4527 - DNA, 21 bp, Artificial Sequence
  Description of Artificial Sequence: Synthetic oligonucleotide
actgatctagagaacacaaga

SEQ ID NO: 4528 - DNA, 22 bp, Artificial Sequence
  Description of Artificial Sequence: Synthetic oligonucleotide
aagcccttaccccaaaaagcat

SEQ ID NO: 4529 - DNA, 22 bp, Artificial Sequence
  Description of Artificial Sequence: Synthetic oligonucleotide
ctaggtatggtcccagggatcc

SEQ ID NO: 4530 - DNA, 20 bp, Artificial Sequence
  Description of Artificial Sequence: Synthetic oligonucleotide
accaggaggctgaggcccct

SEQ ID NO: 4531 - DNA, 23 bp, Artificial Sequence
  Description of Artificial Sequence: Synthetic oligonucleotide
tgtaggctggggataaatgaata

SEQ ID NO: 4532 - DNA, 22 bp, Artificial Sequence
  Description of Artificial Sequence: Synthetic oligonucleotide
gcggtcccgcggcgccccgcct

SEQ ID NO: 4533 - DNA, 21 bp, Artificial Sequence
  Description of Artificial Sequence: Synthetic oligonucleotide
tcccacgttgtggcccagcag

SEQ ID NO: 4534 - DNA, 21 bp, Artificial Sequence
  Description of Artificial Sequence: Synthetic oligonucleotide
ttggccacaatgggttagaac

SEQ ID NO: 4535 - DNA, 22 bp, Artificial Sequence
  Description of Artificial Sequence: Synthetic oligonucleotide
ctcagagcagacgtggttctca

SEQ ID NO: 4536 - DNA, 21 bp, Artificial Sequence
  Description of Artificial Sequence: Synthetic oligonucleotide
aaagtgtcagatacggtgtgg

SEQ ID NO: 4537 - DNA, 21 bp, Artificial Sequence
  Description of Artificial Sequence: Synthetic oligonucleotide
ccaccaccgtgtctgacactt

SEQ ID NO: 4538 - DNA, 23 bp, Artificial Sequence
  Description of Artificial Sequence: Synthetic oligonucleotide
aagtgccgccatcttttgagtgt

SEQ ID NO: 4539 - DNA, 22 bp, Artificial Sequence
  Description of Artificial Sequence: Synthetic oligonucleotide
tgcggggctagggctaacagca

SEQ ID NO: 4540 - DNA, 22 bp, Artificial Sequence
  Description of Artificial Sequence: Synthetic oligonucleotide
tgtctactactggagacactgg

SEQ ID NO: 4541 - DNA, 22 bp, Artificial Sequence
  Description of Artificial Sequence: Synthetic oligonucleotide
cctctagtaaatatgtcagcat

SEQ ID NO: 4542 - DNA, 21 bp, Artificial Sequence
  Description of Artificial Sequence: Synthetic oligonucleotide
tgactgacagctttttgagta

SEQ ID NO: 4543 - DNA, 21 bp, Artificial Sequence
  Description of Artificial Sequence: Synthetic oligonucleotide
cattattacttttggtacgcg

SEQ ID NO: 4544 - DNA, 22 bp, Artificial Sequence
  Description of Artificial Sequence: Synthetic oligonucleotide
caagctcgtgtctgtgggtccg

SEQ ID NO: 4545 - DNA, 23 bp, Artificial Sequence
  Description of Artificial Sequence: Synthetic oligonucleotide
ctacgcgtattcttaagcaataa

SEQ ID NO: 4546 - DNA, 23 bp, Artificial Sequence
  Description of Artificial Sequence: Synthetic oligonucleotide
actccatttgttttgatgatgga

SEQ ID NO: 4547 - DNA, 21 bp, Artificial Sequence
  Description of Artificial Sequence: Synthetic oligonucleotide
agggagggacgggggctgtgc

SEQ ID NO: 4548 - DNA, 22 bp, Artificial Sequence
  Description of Artificial Sequence: Synthetic oligonucleotide
tgtgactggttgaccagagggg

SEQ ID NO: 4549 - DNA, 23 bp, Artificial Sequence
  Description of Artificial Sequence: Synthetic oligonucleotide
agctggtgttgtgaatcaggccg

SEQ ID NO: 4550 - DNA, 23 bp, Artificial Sequence
  Description of Artificial Sequence: Synthetic oligonucleotide
agctggtgttgtgaatcaggccg

SEQ ID NO: 4551 - DNA, 22 bp, Artificial Sequence
  Description of Artificial Sequence: Synthetic oligonucleotide
ctggactgagccgtgctactgg

SEQ ID NO: 4552 - DNA, 18 bp, Artificial Sequence
  Description of Artificial Sequence: Synthetic oligonucleotide
cccccaccaccacgcccg

SEQ ID NO: 4553 - DNA, 22 bp, Artificial Sequence
  Description of Artificial Sequence: Synthetic oligonucleotide
cggcaacaagaaactgcctgag

SEQ ID NO: 4554 - DNA, 22 bp, Artificial Sequence
  Description of Artificial Sequence: Synthetic oligonucleotide
ctggaagtgcccatactacagt

SEQ ID NO: 4555 - DNA, 22 bp, Artificial Sequence
  Description of Artificial Sequence: Synthetic oligonucleotide
taaccaatgtgcagactactgt

SEQ ID NO: 4556 - DNA, 22 bp, Artificial Sequence
  Description of Artificial Sequence: Synthetic oligonucleotide
taaccaatgtgcagactactgt

SEQ ID NO: 4557 - DNA, 22 bp, Artificial Sequence
  Description of Artificial Sequence: Synthetic oligonucleotide
actcagtatgccagggtaccat

SEQ ID NO: 4558 - DNA, 22 bp, Artificial Sequence
  Description of Artificial Sequence: Synthetic oligonucleotide
atccttctacaaattcacccat

SEQ ID NO: 4559 - DNA, 19 bp, Artificial Sequence
  Description of Artificial Sequence: Synthetic oligonucleotide
aagccaaagccttatccat

SEQ ID NO: 4560 - DNA, 18 bp, Artificial Sequence
  Description of Artificial Sequence: Synthetic oligonucleotide
atcccacctctgccacca

SEQ ID NO: 4561 - DNA, 21 bp, Artificial Sequence
  Description of Artificial Sequence: Synthetic oligonucleotide
tggggattacacttcaacagg

SEQ ID NO: 4562 - DNA, 21 bp, Artificial Sequence
  Description of Artificial Sequence: Synthetic oligonucleotide
actagactgtgagctcctcga

SEQ ID NO: 4563 - DNA, 22 bp, Artificial Sequence
  Description of Artificial Sequence: Synthetic oligonucleotide
caggatgtggtcaagtgttgtt

SEQ ID NO: 4564 - DNA, 23 bp, Artificial Sequence
  Description of Artificial Sequence: Synthetic oligonucleotide
caagtcttatttgagcacctgtt

SEQ ID NO: 4565 - DNA, 22 bp, Artificial Sequence
  Description of Artificial Sequence: Synthetic oligonucleotide
tcacaagtcaggctcttgggac

SEQ ID NO: 4566 - DNA, 22 bp, Artificial Sequence
  Description of Artificial Sequence: Synthetic oligonucleotide
caatgtttccacagtgcatcac

SEQ ID NO: 4567 - DNA, 23 bp, Artificial Sequence
  Description of Artificial Sequence: Synthetic oligonucleotide
cgtgagctcctggaggacaggga

SEQ ID NO: 4568 - DNA, 22 bp, Artificial Sequence
  Description of Artificial Sequence: Synthetic oligonucleotide
ctagaagctcacagtctagttg

SEQ ID NO: 4569 - DNA, 23 bp, Artificial Sequence
  Description of Artificial Sequence: Synthetic oligonucleotide
aatctactttctttgctcatcct

SEQ ID NO: 4570 - DNA, 22 bp, Artificial Sequence
  Description of Artificial Sequence: Synthetic oligonucleotide
aaccactttctttgctcatccg

SEQ ID NO: 4571 - DNA, 22 bp, Artificial Sequence
  Description of Artificial Sequence: Synthetic oligonucleotide
cggatgagcaaagaaagtggtt

SEQ ID NO: 4572 - DNA, 22 bp, Artificial Sequence
  Description of Artificial Sequence: Synthetic oligonucleotide
tatggcagactgtgatttgttg

SEQ ID NO: 4573 - DNA, 22 bp, Artificial Sequence
  Description of Artificial Sequence: Synthetic oligonucleotide
taaccaatgtgcagactactgt

SEQ ID NO: 4574 - DNA, 24 bp, Artificial Sequence
  Description of Artificial Sequence: Synthetic oligonucleotide
gaggtgactctatcctatgtcttt

SEQ ID NO: 4575 - DNA, 22 bp, Artificial Sequence
  Description of Artificial Sequence: Synthetic oligonucleotide
aactggcctacaaagtcccagt

SEQ ID NO: 4576 - DNA, 22 bp, Artificial Sequence
  Description of Artificial Sequence: Synthetic oligonucleotide
cccaaaaaattcacctttgggc

SEQ ID NO: 4577 - DNA, 22 bp, Artificial Sequence
  Description of Artificial Sequence: Synthetic oligonucleotide
ctggagacacgtgcactgtaga

SEQ ID NO: 4578 - DNA, 23 bp, Artificial Sequence
  Description of Artificial Sequence: Synthetic oligonucleotide
aggaagccctggaggggctggag

SEQ ID NO: 4579 - DNA, 22 bp, Artificial Sequence
  Description of Artificial Sequence: Synthetic oligonucleotide
ggttcagttgttcaaccagtta

SEQ ID NO: 4580 - DNA, 22 bp, Artificial Sequence
  Description of Artificial Sequence: Synthetic oligonucleotide
ggcaaaaaccacaattactttt

SEQ ID NO: 4581 - DNA, 22 bp, Artificial Sequence
  Description of Artificial Sequence: Synthetic oligonucleotide
ggcaaaaaccacaattactttt

SEQ ID NO: 4582 - DNA, 21 bp, Artificial Sequence
  Description of Artificial Sequence: Synthetic oligonucleotide
actctttccctgttgcactac

SEQ ID NO: 4583 - DNA, 22 bp, Artificial Sequence
  Description of Artificial Sequence: Synthetic oligonucleotide
ctatacaatctattgccttccc

SEQ ID NO: 4584 - DNA, 23 bp, Artificial Sequence
  Description of Artificial Sequence: Synthetic oligonucleotide
agaaaccatggggtatgagcaga

SEQ ID NO: 4585 - DNA, 22 bp, Artificial Sequence
  Description of Artificial Sequence: Synthetic oligonucleotide
tacagatggataccgtgcaatt

SEQ ID NO: 4586 - DNA, 22 bp, Artificial Sequence
  Description of Artificial Sequence: Synthetic oligonucleotide
tgcaacttagtaatgtgcaata

SEQ ID NO: 4587 - DNA, 21 bp, Artificial Sequence
  Description of Artificial Sequence: Synthetic oligonucleotide
agctatgccagcatcttgcct

SEQ ID NO: 4588 - DNA, 22 bp, Artificial Sequence
  Description of Artificial Sequence: Synthetic oligonucleotide
gaaggcgcttccctttagagcg

SEQ ID NO: 4589 - DNA, 23 bp, Artificial Sequence
  Description of Artificial Sequence: Synthetic oligonucleotide
aacattcattgttgtcggtgggt

SEQ ID NO: 4590 - DNA, 20 bp, Artificial Sequence
  Description of Artificial Sequence: Synthetic oligonucleotide
gtgtgtatacatttatacat

SEQ ID NO: 4591 - DNA, 22 bp, Artificial Sequence
  Description of Artificial Sequence: Synthetic oligonucleotide
ggccaaaaccacaattactttt

SEQ ID NO: 4592 - DNA, 21 bp, Artificial Sequence
  Description of Artificial Sequence: Synthetic oligonucleotide
taaagtaaatatgcaccaaaa

SEQ ID NO: 4593 - DNA, 21 bp, Artificial Sequence
  Description of Artificial Sequence: Synthetic oligonucleotide
ttttggtgcatatttacttta

SEQ ID NO: 4594 - DNA, 23 bp, Artificial Sequence
  Description of Artificial Sequence: Synthetic oligonucleotide
aacattcaacgctgtcggtgagt

SEQ ID NO: 4595 - DNA, 23 bp, Artificial Sequence
  Description of Artificial Sequence: Synthetic oligonucleotide
actcaccgacagcgttgaatgtt

SEQ ID NO: 4596 - DNA, 23 bp, Artificial Sequence
  Description of Artificial Sequence: Synthetic oligonucleotide
aacattcattgctgtcggtgggt

SEQ ID NO: 4597 - DNA, 23 bp, Artificial Sequence
  Description of Artificial Sequence: Synthetic oligonucleotide
acccaccgacagcaatgaatgtt

SEQ ID NO: 4598 - DNA, 22 bp, Artificial Sequence
  Description of Artificial Sequence: Synthetic oligonucleotide
aacattcaacctgtcggtgagt

SEQ ID NO: 4599 - DNA, 23 bp, Artificial Sequence
  Description of Artificial Sequence: Synthetic oligonucleotide
taggcagtgtcattagctgattg

SEQ ID NO: 4600 - DNA, 21 bp, Artificial Sequence
  Description of Artificial Sequence: Synthetic oligonucleotide
catcccttgcatggtggaggg

SEQ ID NO: 4601 - DNA, 22 bp, Artificial Sequence
  Description of Artificial Sequence: Synthetic oligonucleotide
tcaccattgctaaagtgcaatt

SEQ ID NO: 4602 - DNA, 22 bp, Artificial Sequence
  Description of Artificial Sequence: Synthetic oligonucleotide
taatgcccctaaaaatccttat

SEQ ID NO: 4603 - DNA, 22 bp, Artificial Sequence
  Description of Artificial Sequence: Synthetic oligonucleotide
taatgcccctaaaaatccttat

SEQ ID NO: 4604 - DNA, 22 bp, Artificial Sequence
  Description of Artificial Sequence: Synthetic oligonucleotide
gccagctaacaatacactgcct

SEQ ID NO: 4605 - DNA, 22 bp, Artificial Sequence
  Description of Artificial Sequence: Synthetic oligonucleotide
ctgaacaccaaaagaaatcagt

SEQ ID NO: 4606 - DNA, 22 bp, Artificial Sequence
  Description of Artificial Sequence: Synthetic oligonucleotide
tagagttacaccctgggagtta

SEQ ID NO: 4607 - DNA, 19 bp, Artificial Sequence
  Description of Artificial Sequence: Synthetic oligonucleotide
tgagctgctgtaccaaaat

SEQ ID NO: 4608 - DNA, 22 bp, Artificial Sequence
  Description of Artificial Sequence: Synthetic oligonucleotide
tattcccctagatacgaatttg

SEQ ID NO: 4609 - DNA, 22 bp, Artificial Sequence
  Description of Artificial Sequence: Synthetic oligonucleotide
ctctagagggaagcgctttctg

SEQ ID NO: 4610 - DNA, 22 bp, Artificial Sequence
  Description of Artificial Sequence: Synthetic oligonucleotide
caaagtttaagatccttgaagt

SEQ ID NO: 4611 - DNA, 20 bp, Artificial Sequence
  Description of Artificial Sequence: Synthetic oligonucleotide
aaagtagctgtaccatttgc

SEQ ID NO: 4612 - DNA, 19 bp, Artificial Sequence
  Description of Artificial Sequence: Synthetic oligonucleotide
aggttgacatacgtttccc

SEQ ID NO: 4613 - DNA, 22 bp, Artificial Sequence
  Description of Artificial Sequence: Synthetic oligonucleotide
gtacccctggagattctgataa

SEQ ID NO: 4614 - DNA, 19 bp, Artificial Sequence
  Description of Artificial Sequence: Synthetic oligonucleotide
gggcgcctgtgatcccaac

SEQ ID NO: 4615 - DNA, 23 bp, Artificial Sequence
  Description of Artificial Sequence: Synthetic oligonucleotide
agtatgttcttccaggacagaac

SEQ ID NO: 4616 - DNA, 22 bp, Artificial Sequence
  Description of Artificial Sequence: Synthetic oligonucleotide
gtccctctccaaatgtgtcttg

SEQ ID NO: 4617 - DNA, 22 bp, Artificial Sequence
  Description of Artificial Sequence: Synthetic oligonucleotide
ctgtgacctatggaattggcag

SEQ ID NO: 4618 - DNA, 23 bp, Artificial Sequence
  Description of Artificial Sequence: Synthetic oligonucleotide
aggttgggatcggttgcaatgct

SEQ ID NO: 4619 - DNA, 22 bp, Artificial Sequence
  Description of Artificial Sequence: Synthetic oligonucleotide
tgctcacaagcagctaagccct

SEQ ID NO: 4620 - DNA, 19 bp, Artificial Sequence
  Description of Artificial Sequence: Synthetic oligonucleotide
aggcacggtgtcagcaggc

SEQ ID NO: 4621 - DNA, 22 bp, Artificial Sequence
  Description of Artificial Sequence: Synthetic oligonucleotide
gtaagaagtgcttacattgcag

SEQ ID NO: 4622 - DNA, 22 bp, Artificial Sequence
  Description of Artificial Sequence: Synthetic oligonucleotide
cctattcttggttacttgcacg

SEQ ID NO: 4623 - DNA, 23 bp, Artificial Sequence
  Description of Artificial Sequence: Synthetic oligonucleotide
tttcaagccagggggcgtttttc

SEQ ID NO: 4624 - DNA, 22 bp, Artificial Sequence
  Description of Artificial Sequence: Synthetic oligonucleotide
gcagagacaatattgatagggt

SEQ ID NO: 4625 - DNA, 21 bp, Artificial Sequence
  Description of Artificial Sequence: Synthetic oligonucleotide
atccttgctatctgggtgcta

SEQ ID NO: 4626 - DNA, 22 bp, Artificial Sequence
  Description of Artificial Sequence: Synthetic oligonucleotide
cgcggtgcttgacagaaccatg

SEQ ID NO: 4627 - DNA, 22 bp, Artificial Sequence
  Description of Artificial Sequence: Synthetic oligonucleotide
agagtaaacagccttctcccag

SEQ ID NO: 4628 - DNA, 22 bp, Artificial Sequence
  Description of Artificial Sequence: Synthetic oligonucleotide
gaaagtgcttccttttagaggc

SEQ ID NO: 4629 - DNA, 23 bp, Artificial Sequence
  Description of Artificial Sequence: Synthetic oligonucleotide
tctcgtgacatgatgatccccga

SEQ ID NO: 4630 - DNA, 22 bp, Artificial Sequence
  Description of Artificial Sequence: Synthetic oligonucleotide
atcatgatgggctcctcggtgt

SEQ ID NO: 4631 - DNA, 21 bp, Artificial Sequence
  Description of Artificial Sequence: Synthetic oligonucleotide
gcggaacttagccactgtgaa

SEQ ID NO: 4632 - DNA, 21 bp, Artificial Sequence
  Description of Artificial Sequence: Synthetic oligonucleotide
ttcacagtggctaagttctgc

SEQ ID NO: 4633 - DNA, 23 bp, Artificial Sequence
  Description of Artificial Sequence: Synthetic oligonucleotide
tctctgcaggccgtgtgctttgc

SEQ ID NO: 4634 - DNA, 21 bp, Artificial Sequence
  Description of Artificial Sequence: Synthetic oligonucleotide
tgtcttgcaggccgtcatgca

SEQ ID NO: 4635 - DNA, 22 bp, Artificial Sequence
  Description of Artificial Sequence: Synthetic oligonucleotide
ctctagagggaagcactttctg

SEQ ID NO: 4636 - DNA, 23 bp, Artificial Sequence
  Description of Artificial Sequence: Synthetic oligonucleotide
cccagctagattgtaagctcctt

SEQ ID NO: 4637 - DNA, 22 bp, Artificial Sequence
  Description of Artificial Sequence: Synthetic oligonucleotide
actgcagtgaaggcacttgtag

SEQ ID NO: 4638 - DNA, 21 bp, Artificial Sequence
  Description of Artificial Sequence: Synthetic oligonucleotide
taggacacatggtctacttct

SEQ ID NO: 4639 - DNA, 22 bp, Artificial Sequence
  Description of Artificial Sequence: Synthetic oligonucleotide
ggtaaaactcgcaattactttt

SEQ ID NO: 4640 - DNA, 27 bp, Artificial Sequence
  Description of Artificial Sequence: Synthetic oligonucleotide
accttcttgtataagcactgtgctaaa

SEQ ID NO: 4641 - DNA, 22 bp, Artificial Sequence
  Description of Artificial Sequence: Synthetic oligonucleotide
acaaaccttttgttcgtcttat

SEQ ID NO: 4642 - DNA, 22 bp, Artificial Sequence
  Description of Artificial Sequence: Synthetic oligonucleotide
acaagctttttgctcgtcttat

SEQ ID NO: 4643 - DNA, 21 bp, Artificial Sequence
  Description of Artificial Sequence: Synthetic oligonucleotide
ttaagacttgcagtgatgttt

SEQ ID NO: 4644 - DNA, 24 bp, Artificial Sequence
  Description of Artificial Sequence: Synthetic oligonucleotide
tctaaaccaccatatgaaaccagc

SEQ ID NO: 4645 - DNA, 22 bp, Artificial Sequence
  Description of Artificial Sequence: Synthetic oligonucleotide
ctcctgactccaggtcctgtgt

SEQ ID NO: 4646 - DNA, 22 bp, Artificial Sequence
  Description of Artificial Sequence: Synthetic oligonucleotide
tcagcagcacagttaatactgg

SEQ ID NO: 4647 - DNA, 22 bp, Artificial Sequence
  Description of Artificial Sequence: Synthetic oligonucleotide
caacaaaatcactgatgctgga

SEQ ID NO: 4648 - DNA, 22 bp, Artificial Sequence
  Description of Artificial Sequence: Synthetic oligonucleotide
ggattcctggaaatactgttct

SEQ ID NO: 4649 - DNA, 22 bp, Artificial Sequence
  Description of Artificial Sequence: Synthetic oligonucleotide
ctcctatatgatgcctttcttc

SEQ ID NO: 4650 - DNA, 25 bp, Artificial Sequence
  Description of Artificial Sequence: Synthetic oligonucleotide
aggcaccagccaggcattgctcagc

SEQ ID NO: 4651 - DNA, 22 bp, Artificial Sequence
  Description of Artificial Sequence: Synthetic oligonucleotide
cagtgcaatgttaaaagggcat

SEQ ID NO: 4652 - DNA, 22 bp, Artificial Sequence
  Description of Artificial Sequence: Synthetic oligonucleotide
tcctcttttcttagagactcac

SEQ ID NO: 4653 - DNA, 22 bp, Artificial Sequence
  Description of Artificial Sequence: Synthetic oligonucleotide
tctacccagaaaggagccagtg

SEQ ID NO: 4654 - DNA, 21 bp, Artificial Sequence
  Description of Artificial Sequence: Synthetic oligonucleotide
ctacgcagaaaggacacagtg

SEQ ID NO: 4655 - DNA, 22 bp, Artificial Sequence
  Description of Artificial Sequence: Synthetic oligonucleotide
acaaaatccacaattacttttg

SEQ ID NO: 4656 - DNA, 28 bp, Artificial Sequence
  Description of Artificial Sequence: Synthetic oligonucleotide
gtcagcagtttgagtgtcagcattgtga

SEQ ID NO: 4657 - DNA, 22 bp, Artificial Sequence
  Description of Artificial Sequence: Synthetic oligonucleotide
agtattctgtaccagggaaggt

SEQ ID NO: 4658 - DNA, 21 bp, Artificial Sequence
  Description of Artificial Sequence: Synthetic oligonucleotide
gctgaggtctgggccaggtct

SEQ ID NO: 4659 - DNA, 22 bp, Artificial Sequence
  Description of Artificial Sequence: Synthetic oligonucleotide
gactcgaaccactgatccagca

SEQ ID NO: 4660 - DNA, 23 bp, Artificial Sequence
  Description of Artificial Sequence: Synthetic oligonucleotide
ctaatagtatctaccacaataaa

SEQ ID NO: 4661 - DNA, 17 bp, Artificial Sequence
  Description of Artificial Sequence: Synthetic oligonucleotide
tcgcctcctcctctccc

SEQ ID NO: 4662 - DNA, 23 bp, Artificial Sequence
  Description of Artificial Sequence: Synthetic oligonucleotide
ggacattgtttcagtgcccaagt

SEQ ID NO: 4663 - DNA, 23 bp, Artificial Sequence
  Description of Artificial Sequence: Synthetic oligonucleotide
tgcgggcgggacgagcaagcaca

SEQ ID NO: 4664 - DNA, 24 bp, Artificial Sequence
  Description of Artificial Sequence: Synthetic oligonucleotide
acgcagagcccgaaagcccccagt

SEQ ID NO: 4665 - DNA, 25 bp, Artificial Sequence
  Description of Artificial Sequence: Synthetic oligonucleotide
agggatcgcgggcgggtggcggcct

SEQ ID NO: 4666 - DNA, 23 bp, Artificial Sequence
  Description of Artificial Sequence: Synthetic oligonucleotide
atcgctgcggttgcgagcgctgt

SEQ ID NO: 4667 - DNA, 23 bp, Artificial Sequence
  Description of Artificial Sequence: Synthetic oligonucleotide
aaaatgcagattcctggactcca

SEQ ID NO: 4668 - DNA, 23 bp, Artificial Sequence
  Description of Artificial Sequence: Synthetic oligonucleotide
aaaatgcagattcctggactcca

SEQ ID NO: 4669 - DNA, 21 bp, Artificial Sequence
  Description of Artificial Sequence: Synthetic oligonucleotide
tggactgccctgatctggaga

SEQ ID NO: 4670 - DNA, 22 bp, Artificial Sequence
  Description of Artificial Sequence: Synthetic oligonucleotide
accaaagaccgcaattactttt

SEQ ID NO: 4671 - DNA, 22 bp, Artificial Sequence
  Description of Artificial Sequence: Synthetic oligonucleotide
caaagcgctcccctttagaggt

SEQ ID NO: 4672 - DNA, 22 bp, Artificial Sequence
  Description of Artificial Sequence: Synthetic oligonucleotide
tgaggtagtaggttgtatggtt

SEQ ID NO: 4673 - DNA, 22 bp, Artificial Sequence
  Description of Artificial Sequence: Synthetic oligonucleotide
tgaggtagtaggttgtatagtt

SEQ ID NO: 4674 - DNA, 22 bp, Artificial Sequence
  Description of Artificial Sequence: Synthetic oligonucleotide
aactatacaacctactacctca

SEQ ID NO: 4675 - DNA, 22 bp, Artificial Sequence
  Description of Artificial Sequence: Synthetic oligonucleotide
tgaggtagtaggttgtatagtt

SEQ ID NO: 4676 - DNA, 22 bp, Artificial Sequence
  Description of Artificial Sequence: Synthetic oligonucleotide
aactatacaatctactacctca

SEQ ID NO: 4677 - DNA, 22 bp, Artificial Sequence
  Description of Artificial Sequence: Synthetic oligonucleotide
tgaggtagtagattgtatagtt

SEQ ID NO: 4678 - DNA, 22 bp, Artificial Sequence
  Description of Artificial Sequence: Synthetic oligonucleotide
aactgtacaaactactacctca

SEQ ID NO: 4679 - DNA, 22 bp, Artificial Sequence
  Description of Artificial Sequence: Synthetic oligonucleotide
agaggtagtaggttgcatagtt

SEQ ID NO: 4680 - DNA, 22 bp, Artificial Sequence
  Description of Artificial Sequence: Synthetic oligonucleotide
tgaggtaggaggttgtatagtt

SEQ ID NO: 4681 - DNA, 18 bp, Artificial Sequence
  Description of Artificial Sequence: Synthetic oligonucleotide
tgcttcctttcagagggt

SEQ ID NO: 4682 - DNA, 18 bp, Artificial Sequence
  Description of Artificial Sequence: Synthetic oligonucleotide
tgcttcctttcagagggt

SEQ ID NO: 4683 - DNA, 22 bp, Artificial Sequence
  Description of Artificial Sequence: Synthetic oligonucleotide
tgaggtagtagtttgtgctgtt

SEQ ID NO: 4684 - DNA, 23 bp, Artificial Sequence
  Description of Artificial Sequence: Synthetic oligonucleotide
ctgcagaactgttcccgctgcta

SEQ ID NO: 4685 - DNA, 22 bp, Artificial Sequence
  Description of Artificial Sequence: Synthetic oligonucleotide
tgaaacatacacgggaaacctc

SEQ ID NO: 4686 - DNA, 22 bp, Artificial Sequence
  Description of Artificial Sequence: Synthetic oligonucleotide
aaagtgcatccttttagaggtt

SEQ ID NO: 4687 - DNA, 21 bp, Artificial Sequence
  Description of Artificial Sequence: Synthetic oligonucleotide
tggcagggaggctgggagggg

SEQ ID NO: 4688 - DNA, 22 bp, Artificial Sequence
  Description of Artificial Sequence: Synthetic oligonucleotide
ctatacaacctactgccttccc

SEQ ID NO: 4689 - DNA, 22 bp, Artificial Sequence
  Description of Artificial Sequence: Synthetic oligonucleotide
ggtacaatcaacggtcgatggt

SEQ ID NO: 4690 - DNA, 22 bp, Artificial Sequence
  Description of Artificial Sequence: Synthetic oligonucleotide
aaaaactgagactacttttgca

SEQ ID NO: 4691 - DNA, 22 bp, Artificial Sequence
  Description of Artificial Sequence: Synthetic oligonucleotide
tccctgagaccctaacttgtga

SEQ ID NO: 4692 - DNA, 22 bp, Artificial Sequence
  Description of Artificial Sequence: Synthetic oligonucleotide
tcacaagttagggtctcaggga

SEQ ID NO: 4693 - DNA, 22 bp, Artificial Sequence
  Description of Artificial Sequence: Synthetic oligonucleotide
actttcggttatctagctttat

SEQ ID NO: 4694 - DNA, 22 bp, Artificial Sequence
  Description of Artificial Sequence: Synthetic oligonucleotide
actttcggttatctagctttat

SEQ ID NO: 4695 - DNA, 22 bp, Artificial Sequence
  Description of Artificial Sequence: Synthetic oligonucleotide
ataaagctagataaccgaaagt

SEQ ID NO: 4696 - DNA, 23 bp, Artificial Sequence
  Description of Artificial Sequence: Synthetic oligonucleotide
cagtgcaatgatattgtcaaagc

SEQ ID NO: 4697 - DNA, 23 bp, Artificial Sequence
  Description of Artificial Sequence: Synthetic oligonucleotide
gctttgacaatactattgcactg

SEQ ID NO: 4698 - DNA, 22 bp, Artificial Sequence
  Description of Artificial Sequence: Synthetic oligonucleotide
aacaatacaacttactacctca

SEQ ID NO: 4699 - DNA, 22 bp, Artificial Sequence
  Description of Artificial Sequence: Synthetic oligonucleotide
tgtcttactccctcaggcacat

SEQ ID NO: 4700 - DNA, 22 bp, Artificial Sequence
  Description of Artificial Sequence: Synthetic oligonucleotide
tgtcttactccctcaggcacat

SEQ ID NO: 4701 - DNA, 22 bp, Artificial Sequence
  Description of Artificial Sequence: Synthetic oligonucleotide
acatcaatacttcctggctccc

SEQ ID NO: 4702 - DNA, 23 bp, Artificial Sequence
  Description of Artificial Sequence: Synthetic oligonucleotide
tccataaagtaggaaacactaca

SEQ ID NO: 4703 - DNA, 22 bp, Artificial Sequence
  Description of Artificial Sequence: Synthetic oligonucleotide
aatcatacagggacatccagtt

SEQ ID NO: 4704 - DNA, 23 bp, Artificial Sequence
  Description of Artificial Sequence: Synthetic oligonucleotide
ctacctgcacgaacagcactttg

SEQ ID NO: 4705 - DNA, 22 bp, Artificial Sequence
  Description of Artificial Sequence: Synthetic oligonucleotide
tgctcaataaatacccgttgaa

SEQ ID NO: 4706 - DNA, 23 bp, Artificial Sequence
  Description of Artificial Sequence: Synthetic oligonucleotide
agcaaaaatgtgctagtgccaaa

SEQ ID NO: 4707 - DNA, 22 bp, Artificial Sequence
  Description of Artificial Sequence: Synthetic oligonucleotide
cgtcttacccagcagtgtttgg

SEQ ID NO: 4708 - DNA, 20 bp, Artificial Sequence
  Description of Artificial Sequence: Synthetic oligonucleotide
ctgcaaagggaagccctttc

SEQ ID NO: 4709 - DNA, 22 bp, Artificial Sequence
  Description of Artificial Sequence: Synthetic oligonucleotide
aacgcacttccctttagagtgt

SEQ ID NO: 4710 - DNA, 22 bp, Artificial Sequence
  Description of Artificial Sequence: Synthetic oligonucleotide
aacgcacttccctttagagtgt

SEQ ID NO: 4711 - DNA, 22 bp, Artificial Sequence
  Description of Artificial Sequence: Synthetic oligonucleotide
tcggatccgtctgagcttggct

SEQ ID NO: 4712 - DNA, 23 bp, Artificial Sequence
  Description of Artificial Sequence: Synthetic oligonucleotide
gaacgcgcttccctatagagggt

SEQ ID NO: 4713 - DNA, 23 bp, Artificial Sequence
  Description of Artificial Sequence: Synthetic oligonucleotide
tcacataggaatgaaaagccata

SEQ ID NO: 4714 - DNA, 23 bp, Artificial Sequence
  Description of Artificial Sequence: Synthetic oligonucleotide
tcacataggaataaaaagccata

SEQ ID NO: 4715 - DNA, 23 bp, Artificial Sequence
  Description of Artificial Sequence: Synthetic oligonucleotide
tatggctttttattcctatgtga

SEQ ID NO: 4716 - DNA, 22 bp, Artificial Sequence
  Description of Artificial Sequence: Synthetic oligonucleotide
tgagaactgaattccataggct

SEQ ID NO: 4717 - DNA, 22 bp, Artificial Sequence
  Description of Artificial Sequence: Synthetic oligonucleotide
ctacccacagacgtaccaatca

SEQ ID NO: 4718 - DNA, 22 bp, Artificial Sequence
  Description of Artificial Sequence: Synthetic oligonucleotide
ctacccacagacgtaccaatca

SEQ ID NO: 4719 - DNA, 22 bp, Artificial Sequence
  Description of Artificial Sequence: Synthetic oligonucleotide
ctacccacagacgtaccaatca

SEQ ID NO: 4720 - DNA, 22 bp, Artificial Sequence
  Description of Artificial Sequence: Synthetic oligonucleotide
gggctgcactgccgaggcactg

SEQ ID NO: 4721 - DNA, 22 bp, Artificial Sequence
  Description of Artificial Sequence: Synthetic oligonucleotide
ctgttgccactaacctcaacct

SEQ ID NO: 4722 - DNA, 18 bp, Artificial Sequence
  Description of Artificial Sequence: Synthetic oligonucleotide
gtccctgttcaggcgcca

SEQ ID NO: 4723 - DNA, 22 bp, Artificial Sequence
  Description of Artificial Sequence: Synthetic oligonucleotide
catgccttgagtgtaggaccgt

SEQ ID NO: 4724 - DNA, 17 bp, Artificial Sequence
  Description of Artificial Sequence: Synthetic oligonucleotide
tggcgcccgaacaggga

SEQ ID NO: 4725 - DNA, 22 bp, Artificial Sequence
  Description of Artificial Sequence: Synthetic oligonucleotide
ctgcgcaagctactgccttgct

SEQ ID NO: 4726 - DNA, 22 bp, Artificial Sequence
  Description of Artificial Sequence: Synthetic oligonucleotide
cgaccatggctgtagactgtta

SEQ ID NO: 4727 - DNA, 22 bp, Artificial Sequence
  Description of Artificial Sequence: Synthetic oligonucleotide
actgcattatgagcacttaaag

SEQ ID NO: 4728 - DNA, 21 bp, Artificial Sequence
  Description of Artificial Sequence: Synthetic oligonucleotide
ggaaatccctggcaatgtgat

SEQ ID NO: 4729 - DNA, 21 bp, Artificial Sequence
  Description of Artificial Sequence: Synthetic oligonucleotide
atcacattgccagggattacc

SEQ ID NO: 4730 - DNA, 22 bp, Artificial Sequence
  Description of Artificial Sequence: Synthetic oligonucleotide
tttcagttatcaatctgtcaca

SEQ ID NO: 4731 - DNA, 22 bp, Artificial Sequence
  Description of Artificial Sequence: Synthetic oligonucleotide
tcagtgcatcacagaactttgt

SEQ ID NO: 4732 - DNA, 22 bp, Artificial Sequence
  Description of Artificial Sequence: Synthetic oligonucleotide
acaaagttctgtagtgcactga

SEQ ID NO: 4733 - DNA, 21 bp, Artificial Sequence
  Description of Artificial Sequence: Synthetic oligonucleotide
aagggtcagtaagcacccgcg

SEQ ID NO: 4734 - DNA, 22 bp, Artificial Sequence
  Description of Artificial Sequence: Synthetic oligonucleotide
ctgttcctgctgaactgagcca

SEQ ID NO: 4735 - DNA, 22 bp, Artificial Sequence
  Description of Artificial Sequence: Synthetic oligonucleotide
tggctcagttcagcaggaacag

SEQ ID NO: 4736 - DNA, 22 bp, Artificial Sequence
  Description of Artificial Sequence: Synthetic oligonucleotide
gcctaagacacaggcccagaga

SEQ ID NO: 4737 - DNA, 22 bp, Artificial Sequence
  Description of Artificial Sequence: Synthetic oligonucleotide
tctaacaccacagtgtggtttg

SEQ ID NO: 4738 - DNA, 22 bp, Artificial Sequence
  Description of Artificial Sequence: Synthetic oligonucleotide
aactcagtaatggtaacggttt

SEQ ID NO: 4739 - DNA, 22 bp, Artificial Sequence
  Description of Artificial Sequence: Synthetic oligonucleotide
tcagtttcctctgcaaacagtt

SEQ ID NO: 4740 - DNA, 22 bp, Artificial Sequence
  Description of Artificial Sequence: Synthetic oligonucleotide
gctataaagtaactgagacgga

SEQ ID NO: 4741 - DNA, 23 bp, Artificial Sequence
  Description of Artificial Sequence: Synthetic oligonucleotide
accctataagcaatattgcacta

SEQ ID NO: 4742 - DNA, 21 bp, Artificial Sequence
  Description of Artificial Sequence: Synthetic oligonucleotide
caactgatgcctttccaagta

SEQ ID NO: 4743 - DNA, 22 bp, Artificial Sequence
  Description of Artificial Sequence: Synthetic oligonucleotide
cccatggcttttagccctacat

SEQ ID NO: 4744 - DNA, 21 bp, Artificial Sequence
  Description of Artificial Sequence: Synthetic oligonucleotide
cacaacctcagtgtttccagg

SEQ ID NO: 4745 - DNA, 25 bp, Artificial Sequence
  Description of Artificial Sequence: Synthetic oligonucleotide
aaaggattctgctgtcggtcccact

SEQ ID NO: 4746 - DNA, 22 bp, Artificial Sequence
  Description of Artificial Sequence: Synthetic oligonucleotide
gaaacaagtaatcaagaatagg

SEQ ID NO: 4747 - DNA, 22 bp, Artificial Sequence
  Description of Artificial Sequence: Synthetic oligonucleotide
cagcaggtacccccatgttaaa

SEQ ID NO: 4748 - DNA, 22 bp, Artificial Sequence
  Description of Artificial Sequence: Synthetic oligonucleotide
tatccactacaccccgctgcct

SEQ ID NO: 4749 - DNA, 22 bp, Artificial Sequence
  Description of Artificial Sequence: Synthetic oligonucleotide
tatggatgcaaaatgatcccaa

SEQ ID NO: 4750 - DNA, 21 bp, Artificial Sequence
  Description of Artificial Sequence: Synthetic oligonucleotide
acaggattgagggggggccct

SEQ ID NO: 4751 - DNA, 22 bp, Artificial Sequence
  Description of Artificial Sequence: Synthetic oligonucleotide
aaatctacattgtatgccaggt

SEQ ID NO: 4752 - DNA, 22 bp, Artificial Sequence
  Description of Artificial Sequence: Synthetic oligonucleotide
catacctatagatacaagcttg

SEQ ID NO: 4753 - DNA, 22 bp, Artificial Sequence
  Description of Artificial Sequence: Synthetic oligonucleotide
gaaagcacttccatgttaaagt

SEQ ID NO: 4754 - DNA, 22 bp, Artificial Sequence
  Description of Artificial Sequence: Synthetic oligonucleotide
aatcgtacagggtcatccactt

SEQ ID NO: 4755 - DNA, 21 bp, Artificial Sequence
  Description of Artificial Sequence: Synthetic oligonucleotide
gttatagatctggatttgaac

SEQ ID NO: 4756 - DNA, 22 bp, Artificial Sequence
  Description of Artificial Sequence: Synthetic oligonucleotide
gactatagaactttccccctca

SEQ ID NO: 4757 - DNA, 22 bp, Artificial Sequence
  Description of Artificial Sequence: Synthetic oligonucleotide
tgagggggaaagttctatagtc

SEQ ID NO: 4758 - DNA, 22 bp, Artificial Sequence
  Description of Artificial Sequence: Synthetic oligonucleotide
catcttccagtacagtgttgga

SEQ ID NO: 4759 - DNA, 21 bp, Artificial Sequence
  Description of Artificial Sequence: Synthetic oligonucleotide
aaactactgaaaatcaaagat

SEQ ID NO: 4760 - DNA, 22 bp, Artificial Sequence
  Description of Artificial Sequence: Synthetic oligonucleotide
ctcctacatattagcattaaca

SEQ ID NO: 4761 - DNA, 22 bp, Artificial Sequence
  Description of Artificial Sequence: Synthetic oligonucleotide
tgagaactgaattccatgggtt

SEQ ID NO: 4762 - DNA, 27 bp, Artificial Sequence
  Description of Artificial Sequence: Synthetic oligonucleotide
cactgtaggtgatggtgagagtgggca

What is claimed:

1. An isolated nucleotide sequence differing by no more than one nucleotide from the sequence of SEQ ID NO: 236, wherein the nucleotide sequence is 19, 20, 21, or 22 nucleotides in length.

2. An isolated nucleotide sequence that is 19, 20, 21, or 22 nucleotides and length and is complementary to the nucleic acid of claim 1.

3. An isolated nucleotide sequence that is 19, 20, 21, or 22 nucleotides and length and is complementary to all but 1, 2, 3, 4, or 5 nucleotides of the nucleotide sequence of claim 2.

4. An isolated nucleotide sequence that is 19, 20, 21, or 22 nucleotides, wherein the nucleotide sequence is complementary to at least 19, 20, 21, or 22 nucleotides of the nucleotide sequence of claim 1.

5. The nucleic acid of claim 1, wherein the nucleotide sequence is single stranded.

6. The nucleic acid of claim 2, wherein the nucleotide sequence is single stranded.

7. The nucleic acid of claim 3, wherein the nucleotide sequence is single stranded.

8. The nucleic acid of claim 1, wherein the nucleotide sequence is expressed by a B cell.

9. The nucleotide sequence of claim 8, wherein the B cell comprises a Naïve B cell, a centroblast, a memory B cell, or a Ramos Burkitt Lymphoma cell.

10. A composition comprising one or more nucleotide sequences of claim 1.

11. The composition of claim 10, further comprising one or more carriers, excipients, solvents, bases, or a combination thereof.

12. A composition comprising one or more nucleotide sequences of claim 2.

13. A composition comprising one or more nucleotide sequences of claim 3.

14. The composition of claim 12 or 13, further comprising one or more carriers, excipients, solvents, bases, or a combination thereof.

* * * * *